US008883735B2

(12) United States Patent
Jenkins et al.

(10) Patent No.: US 8,883,735 B2

(45) Date of Patent: Nov. 11, 2014

(54) LOW DENSITY LIPOPROTEIN-RELATED PROTEIN 6 (LRP6)-HALF LIFE EXTENDER CONSTRUCTS

(71) Applicant: Novartis AG, Basel (CH)

(72) Inventors: David Jenkins, Carlisle, MA (US); Ming Lei, Acton, MA (US); Andreas Loew, Somerville, MA (US); Li Zhou, West Roxbury, MA (US)

(73) Assignee: Novartis AG, Basel (CH)

( * ) Notice: Subject to any disclaimer, the term of this patent is extended or adjusted under 35 U.S.C. 154(b) by 0 days.

(21) Appl. No.: 13/667,284

(22) Filed: Nov. 2, 2012

(65) Prior Publication Data

US 2014/0050725 A1 Feb. 20, 2014

Related U.S. Application Data

(60) Provisional application No. 61/555,848, filed on Nov. 4, 2011.

(51) Int. Cl.

| | |
|---|---|
| ***A61P 35/00*** | (2006.01) |
| ***C07K 14/76*** | (2006.01) |
| ***C07K 19/00*** | (2006.01) |
| ***C12P 21/08*** | (2006.01) |
| ***A61K 39/395*** | (2006.01) |
| ***C12N 15/09*** | (2006.01) |
| ***C12N 15/11*** | (2006.01) |
| ***C12N 15/13*** | (2006.01) |
| ***C12N 15/14*** | (2006.01) |
| ***C07K 16/46*** | (2006.01) |
| ***C07K 16/28*** | (2006.01) |
| ***C07K 14/775*** | (2006.01) |
| *A61K 39/00* | (2006.01) |

(52) U.S. Cl.

CPC ........... *C07K 16/46* (2013.01); *A61K 39/39558* (2013.01); *A61K 2039/505* (2013.01); *C07K 2319/30* (2013.01); *C07K 2317/76* (2013.01); *C07K 2319/31* (2013.01); *C12N 2740/15041* (2013.01); *C07K 16/28* (2013.01); *C07K 2317/35* (2013.01); *C07K 2317/94* (2013.01); *C07K 2317/55* (2013.01); *C07K 14/775* (2013.01); *C07K 2317/622* (2013.01); *Y10S 424/809* (2013.01)

USPC .... 514/19.3; 514/15.2; 514/772; 530/388.22; 530/387.3; 530/362; 424/135.1; 424/136.1; 424/143.1; 424/809; 435/69.1; 435/325; 435/320.1; 536/23.4

(58) Field of Classification Search

None

See application file for complete search history.

(56) References Cited

U.S. PATENT DOCUMENTS

| | | | |
|---|---|---|---|
| 7,622,267 | B2 | 11/2009 | Williams et al. |
| 2004/0244069 | A1 | 12/2004 | Askew et al. |

(Continued)

FOREIGN PATENT DOCUMENTS

| | | | |
|---|---|---|---|
| JP | 2007-536938 | A | 12/2007 |
| WO | 02/092015 | A2 | 11/2002 |

(Continued)

OTHER PUBLICATIONS

Mueller et al., Journal of Biological Chemistry, American Society for Biochemistry and Molecular Biology, 282 (17:12650-12660 (2007).

(Continued)

*Primary Examiner* — Zachary Howard

(74) *Attorney, Agent, or Firm* — Lando & Anastasi, LLP

(57) ABSTRACT

The present invention relates to LRP6 constructs that bind to LRP6 receptor. The LRP6 constructs comprise at least one LRP6 binding moiety and a half-life extender molecule such that the LRP6 construct inhibit the Wnt signaling pathway without potentiation of the Wnt signal. The LRP6 constructs also have an increased half-life to provide more time for the therapeutic benefit.

34 Claims, 60 Drawing Sheets scFv8168 VH8168 VL8168 scFv6475 VL6475 VH6475

801 VH8168 * VL8168 ○ HSA ○○ VL6475 * VH6475

802 VL6475 * VH6475 ○ HSA ○○ VH8168 * VL8168

* linker 4G4S
○ linker AAS
○○ linker AAAL
■ TEV site
▨ His Tag

(56) References Cited

U.S. PATENT DOCUMENTS

| | | | |
|---|---|---|---|
| 2005/0070699 | A1 | 3/2005 | Allen et al. |
| 2005/0084494 | A1 | 4/2005 | Prockop et al. |
| 2006/0257892 | A1 | 11/2006 | Cohen et al. |
| 2010/0254980 | A1 | 10/2010 | Cong et al. |
| 2013/0064823 | A1 | 3/2013 | Cong et al. |

FOREIGN PATENT DOCUMENTS

| | | | |
|---|---|---|---|
| WO | 2006/055635 | A2 | 5/2006 |
| WO | 2006/089114 | A2 | 8/2006 |
| WO | 2009032782 | A2 | 3/2009 |
| WO | 2009056634 | A2 | 5/2009 |
| WO | 2009064944 | A2 | 5/2009 |
| WO | 2009126920 | A2 | 10/2009 |
| WO | 2010/059315 | | 5/2010 |
| WO | 2011047180 | A1 | 4/2011 |
| WO | 2011/119661 | A1 | 9/2011 |
| WO | 2011138391 | A1 | 11/2011 |
| WO | 2011138392 | A1 | 11/2011 |
| WO | 2013/067355 | A1 | 5/2013 |

OTHER PUBLICATIONS

Abbas, et al: Cellular and Molecular Immunology (Eds. Abass et al.: 1991: WB Saunders: Philadelphia: p. 54).

Ai et al: 'Reduced Affinity to and Inhibition by DKK1 Form a Common Mechanism by Which High Bone Mass-Associated Missense Mutations in LRP5 Affect Canonical Wnt Signaling' Molecular and Cellular Biology vol. 25, No. 12, Jun. 15, 2005, pp. 4946-4955, XP055034028 DOI: 10.1128/MCB.25.12.4946-4955.2005 ISSN: 0270-7306.

Binnerts et al: "The First Propeller Domain of LRP6 Regulates Sensitivity to DKK1", Molecular Biology of the Cell, vo1 20, No. 15, Aug. 1, 2009. pp. 3552-3560.

Bourhis et al., "Reconstitution of a frizzled8.Wnt3a.LRP6 signaling complex reveals multiple Wnt and Dkk1 binding sites on LRP6." Journal of Biological Chemistry, American Society for Biochemistry and Molecular Biology, 285 (12):9172-9179 (2010).

Davidson, et al "Kremen proteins interact with Dickkopfl to regulate anteroposterior CNS patterning" Development, vol. 129, No. 24, 2002, pp. 5587-5596.

Ettenberg et al: "Inhibition of tumorigenesis driven by different Wnt proteins requires blockade of distinct ligand-binding regions by LRP6 antibodies", Proceedings of the National Academy of Sciences, vol. 107, No. 35, Aug. 31, 2010, pp. 15473-15478, XP55002447, ISSN: 0027-8424, DOI: 10.1073/pnas.1007428107.

Gong et al: "Wnt Isoform-Specific Interactions with Coreceptor Specify Inhibition or Potentiation of Signaling by LRP6 Antibodies", PLOS ONE. vo1 5, No. 9, Sep. 13, 2010. p. E12682.

He, et al. LDL Receptor-related proteins 5 and 6 Wnt/β-catenin signaling: Arrows point the way (Development, 131: 1663-1677, 2004).

International Preliminary Report on Patentability for PCT/EP2011/057202 dated Nov. 6, 2012.

International Preliminary Report on Patentablity & Written Opinion for PCT/EP2011/057200 dated Jul. 29, 2011.

International Search Report for PCT/EP2008/064821 dated Oct. 23, 2009.

International Search Report for PCT/EP2011/057202 dated Nov. 10, 2011.

International Search Report for PCT/US2012/063330 dated Apr. 10, 2013.

International Serach Report for PCT/EP2011/057200 dated Jul. 29, 2011.

Li et al: "Second cysteine-rich domain of Dickkopf-2 activates canonical Wnt signaling pathway via LRP-6 independently of dishevelled." The Journal of Biological Chemistry Feb. 22, 2002, vol. 277, No. 8, Feb. 22, 2002, pp. 5977-5981, XP002538337 ISSN: 0021-9258.

Mao et al., "Kremen proteins are Dickkopf receptors that regulate Wnt/beta-catenin signalling", Nature: International Weekly Journal of Science, 417(6889):664-667 (2002).

Third Party Observations against European Patent Application No. 08 844 924.4 filed with the European Patent Office on Apr. 16, 2012.

Wei et al., "The LDL receptor-related protein LRP6 mediates internalization and lethality of anthrax toxin." Cell, 124:1141-1154 (2006).

Written Opinion for PCT/EP2008/064821 dated Oct. 23, 2009.

Written Opinion for PCT/EP2011/057202 dated Nov. 6, 2012.

Zahid et al: "Analysis of endogenous LRP6 function reveals a novel feedback mechanism by which Wnt negatively regulates its receptor." Molecular and Cellular Biology Oct. 2007, vol. 27, No. 20, Oct. 2007, pp. 7291-7301, XP002538338 ISSN: 0270-7306.

| MOR06475 scFv-MSA | 0.1340 |
|---|---|
| MOR06475-Fab-MSA | 0.09372 |

| Construct | Wnt1-STF IC50 (nM) | Wnt3a-STF IC50 (nM) |
|---|---|---|
| anti-LRP6_MOR08168 Fab-MSA (C:S) MOR06475 scFv | 0.48 | 0.37 |
| anti-LRP6_MOR08168 Fab-HSA (C:S) MOR06475 scFv | 0.47 | 0.39 |
| anti-LRP6_MOR08168 Fab-HSA (C:S) MOR06475 scFab | 0.98 | 7.9 |
| anti-LRP6_MOR08168 hIgG1LALA (mut Hinge F:T; Y:D) MOR06475 scFv | 0.28 | 0.40 |
| anti-LRP6_MOR08168 hIgG1LALA 2(CH2_CH3) (mut Hinge F:T; Y:D) MOR06475 scFv | 0.42 | 0.25 |

FIG. 2

| HSA fusion molecule structures | | | | |
|---|---|---|---|---|
| Construct nickname | module 1 | Module 2 | Module 3 | Linker 1/2 |
| 801T | scFv8168 | HSA | scFv6475 | AAS/AAAL |
| 802T | scFv6475 | HSA | scFv8168 | AAS/AAAL |
| 803T | scFv8168 | HSA | scFv6475 | G4SGG/3G4S |
| 804T | scFv6475 | HSA | scFv8168 | G4SGG/3G4S |
| 801T–no tag (NT) | scFv8168 | HSA | scFv6475 | AAS/AAAL |
| 802T–no tag (NT) | scFv6475 | HSA | scFv8168 | AAS/AAAL |
| 802T–no linker (NL) | scFv6475 | HSA | scFv8168 | No linker |
| 808T | scFv6475 | HSA | scFv6475 | KTHT/KTHT |
| 812T | scFv6487 | scFv8168 | | 3G4S |
| 812T–HSA | scFv6487 | scFv8168 | HSA | 3G4S/DKTHT |
| 809T | scFV8168 | HSA | | G4S |
| 810T | scFv6475 | HSA | | G4S |
| 801TF | scFv8168 | HSA | scFv6475 | No linker |
| 802TF | scFv6475 | HSA | scFv8168 | No linker |

FIG.9

Purification of 801T and 802T using Ni-NTA

Purification of 801T-no tag and 802T-no tag

801T-Final and 802TF purification

| Thermostability measurement of HSA fusion based biparatopic molecules | | |
|---|---|---|
| | $T_m$ by DSF (ProteoSTAT) | $T_m$ by DSC |
| scFv8168–HSA–scFv6475 (801) | 55, 69 | 53.7, 57.8, 71.4 |
| scFv8168–HSA–scFv6475 (801T) | 62 | 62.4, 71.3 |
| scFv6475–HSA–scFv8168 (802) | 53.5, 60 | 51.0, 65, 72.0 |
| scFv6475–HSA–scFv8168 (802T) | 65.5 | 64.5, 72.6 |

FIG. 11

| Thermostability by DSF | |
|---|---|
| | Tm |
| 801T | 62 |
| 802T | 65.5 |
| 803T | 63 |
| 804T | 66 |
| 801T-no tag | 63 |
| 802T-no tag | 65 |
| 802T-no linker | 64.5 |
| 808T | 66 |
| 812T | 55 |
| 812T-HSA | 60, 64.5 |
| 801TF | 64 |
| 802TF | 66 |
| 911T | 53.5, 60 |
| 912T | 52.5, 62 |

FIG. 14

| Aggregation by analytical SEC after multiple freeze-and-thaws (FTs) | |
|---|---|
| Sample | Percent monomer |
| 802T-2 FTs | 99 |
| 802T-3 FTs | 99 |
| 802T-4 FTs | 99 |
| 802T-nolinker-2 FTs | 94 |
| 802T-nolinker-3 FTs | 94 |
| 802T-nolinker-4 FTs | 94 |
| 804T-2 FTs | 100 |
| 804T-3 FTs | 100 |
| 804T-4 FTs | 97 |
| 808T-2 FTs | 100 |
| 808T-3 FTs | 94 |
| 808T-4 FTs | 94 |

FIG. 16

| | 801T | 802T | 802T-NL | 812T-HSA | 809 | 810 | 803T | 804T |
|---|---|---|---|---|---|---|---|---|
| EC50 | 0.07767 | 0.1793 | 0.1871 | 0.2104 | 0.5388 | 157.6 | 0.3388 | 0.2105 |

| | 801T | 802T | 802T-NL | 812T-HSA | 809 | 810 | 803T |
|---|---|---|---|---|---|---|---|
| EC50 | 0.1436 | 0.2885 | 0.08363 | 0.2928 | 75.50 | 0.4578 | 0.3360 |

| | 801T | 802T | 804T | 802T NL | 801T NT | 802T NT | 809 | 810 |
|---|---|---|---|---|---|---|---|---|
| EC50 | 0.1343 | 0.2324 | 0.2712 | 0.6371 | 0.5545 | 0.3739 | 0.9083 | 3.127 |

| | 812T-HSA | 802T |
|---|---|---|
| EC50 | 0.2147 | 0.2768 |

| | 802TF | 802T | SCfV8168-HSA (809) | SCfV6475-HSA (810) |
|---|---|---|---|---|
| EC50 | 0.1269 | 0.1153 | 0.4716 | 0.3595 |

| ID | Desc | His Tag | Linker | IC50 (nM) | |
|---|---|---|---|---|---|
| | | | | Wnt1 | Wnt3A |
| 801T | scFv8168-HSA-scFv6475 | Y | AAS/AAAL | 0.133 | 0.098 |
| 802T | scFv6475-HSA-scFv8168 | Y | AAS/AAAL | 0.102 | 0.087 |
| 801T-no tag | scFv8168-HSA-scFv6475 | N | AAS/AAAL | 0.160 | 0.118 |
| 802T-no tag | scFv6475-HSA-scFv8168 | N | AAS/AAAL | 0.074 | 0.084 |
| 803T | scFv8168-HSA-scFv6475 | Y | G4SGG/3G4S | 0.082 | 0.117 |
| 804T | scFv6475-HSA-scFv8168 | Y | G4SGG/3G4S | 0.062 | 0.099 |
| 802T-no linker | scFv6475-HSA-scFv8168 | Y | - | 0.071 | 0.097 |
| 808T | scFv6475-HSA-scFv8168 | Y | KTHT | 0.074 | 0.076 |
| 809 | ScFv8168 D1-HSA (VH: I34M, S49A) | Y | | 0.500 | N.D. |
| 810 | ScFv6475 S8-HSA (VH: M100F) | Y | | N.D. | 1.930 |

"T" = Mutation: 8168VH-S49A, I34M/6475VH-M95F

FIG. 19E

| scFv-Fc-scFv fusion molecule structure | | | |
|---|---|---|---|
| | Module 1 | Module 2 | Module 3 |
| 911T | scFv8168 | Fc | scFv6475 |
| 912T | scFv6475 | Fc | scFv8168 |

FIG.25

| Tm of single point mutations in scFv06475 | | | |
|---|---|---|---|
| Construct ID | mutation[a] | $T_m$ on protein from E.coli | $T_m$ on protein from mammalian |
| scFv06475 WT | | 59 | 61 |
| 6475-S2 | VH:G34V | 61 | 64 |
| 6475-S3 | VH:I37F | 61 | 64.5 |
| 6475-S6 | VH:V85E | 60 | 62.5 |
| 6475-S8 | VH:M95F | 61.5 | 64.5 |
| 6475-S9 | VL:D93N | 59.5 | 60.5 |

[a] Both kabat and Chothia numbering system have been used. The numbering is the same for all mutations but VH: G34V in scFv6475. This would be VH: G32V in Chothia numbering system. The numbering system in the text is Kabat system.

FIG.32

| Tm of single point mutations in scFv08168 | | |
|---|---|---|
| Construct ID | mutation | $T_m$ on protein from E.coli[a] |
| WT | WT | 48.50 |
| B02 | VH:V033N | 50.50 |
| B03-S1 | VH:I034M | 56.00 |
| B04 | VH:I034F | 52.50 |
| C05 | VH:S049A | 54.00 |
| C07 | VH:G050S | 51.50 |
| C08 | VH:W052aG | 55.50 |
| C10 | VH:H058Y | 52.00 |
| F11 | VL:V047L | 51.00 |
| G02 | VL:G064V | 50.50 |
| G07 | VL:T078V | 51.00 |

[a] Proteins were expressed from Acella strain. Samples were analyzed by DSF without removal of imidazole.

FIG. 33

| Tm of single vs double mutations in scFv08168 | | | | |
|---|---|---|---|---|
| Construct ID | Mutation | $T_m$ on protein from E.coli [a] | $T_m$ on protein from mammalian [b] | $T_m$ on protein from mammalian |
| scFv08168 WT | WT | 48.50 | 49 | 49 |
| scFv08168 B02 | VH:V33N | 50.50 | | |
| scFv08168 B03-S1 | VH:I34M | 56.00 | 57 | 56.5 |
| scFv08168 B04 | VH:I34F | 52.50 | | |
| scFv08168 C05 | VH:S49A | 54.00 | | |
| scFv08168 C07 | VH:G50S | 51.50 | | |
| scFv08168 C10 | VH:H58Y | 52.00 | | |
| scFv08168 F11 | VL:V47L | 51.00 | | |
| scFv08168 G02 | VL:G64V | 50.50 | | |
| scFv08168 G07 | VL:T78V | 51.00 | | |

[a] Proteins were expressed from Acella strain. Samples were analyzed by DSF without removal of imidazole.

[b] Protein expressed from 293T suspension cells. Samples were analyzed by DSF without removal of imidazole.

FIG. 34A

| Tm of single vs double mutations in scFv08168 | | | | |
|---|---|---|---|---|
| Construct ID | Mutation | $T_m$ on protein from E.coli [a] | $T_m$ on protein from mammalian [b] | $T_m$ on protein from mammalian |
| scFv08168D1 | VH S49A, I34M | 61 | 61.5 | 62.5 |
| scFv08168D2 | VH S49A, I34F | 57.5 | 58 | 58.5 |
| scFv08168D4 | VH I34M, G50S | 59.5 | 59.5 | 60 |
| scFv08168D5 | VH I34M, H58Y | 59 | 59 | 59 |
| scFv08168D6 | VH I34M, V48I | 57 | 58 | 57.5 |
| scFv08168D7 | VH I34M, VLS22T | 57 | 57 | 58 |
| scFv08168D8 | VH I34M, VLV47L | 57.5 | 58 | 58.5 |
| scFv08168D9 | VH I34M, VLG54V | 57.5 | 58.5 | 57.5 |

[a] Proteins were expressed from Acella strain. Samples were analyzed by DSF without removal of imidazole.

[b] Protein expressed from 293T suspension cells. Samples were analyzed by DSF without removal of imidazole.

FIG.34B

| Activity of scFv06475, scFv08168 and the variants in different assays | | | | | |
|---|---|---|---|---|---|
| Construct ID | Mutations | EC50 by ELISA nM | Affinity by Proteon nM | IC50 by STF assay for Wnt1 inhibition (nM) | IC50 by STF assay for Wnt3a inhibition (nM) |
| scFv06475 WT | | 0.76 | – | – | 1.48 |
| scFv06475-S2 | VH:G34V | 27.4 | – | – | – |
| scFv06475-S3 | VH:I37F | 4.3 | – | – | – |
| scFv06475-S6 | VH:V85E | 0.73 | – | – | 1.33 |
| **scFv06475-S8** | **VH:M95F** | **1.0** | **–** | **–** | **0.96** |
| scFv06475-S9 | VL:D93N | 0.88 | – | – | |
| scFv08168 WT | | 2.04 | 3.82 | 7.41 | – |
| scFv08168 B03-S1 | VH:I34M | 0.98 | – | 5.19 | – |
| **scFv08168-D1** | **VH S49A, I34M** | **1.61** | **2.55** | **2.44** | **–** |
| scFv08168-D2 | VH S49A, I34F | 1.68 | – | 2.59 | – |
| scFv08168-D4 | VH I34M, G50S | 1.47 | – | 5.56 | – |
| scFv08168-D5 | VH I34M, H58Y | 1.22 | – | – | – |
| scFv08168-D6 | VH I34M, V48I | 1.24 | – | 0.74 | – |
| scFv08168-D7 | VH I34M, VL S22T | 1.15 | – | 4.81 | – |
| scFv08168-D8 | VH I34M, VL V47L | 0.91 | – | – | – |
| scFv08168-D9 | VH I34M, VL G64V | 1.26 | – | 11.11 | – |

FIG.35

LOW DENSITY LIPOPROTEIN-RELATED PROTEIN 6 (LRP6)-HALF LIFE EXTENDER CONSTRUCTS

RELATED APPLICATIONS

This application claims priority to U.S. Provisional Application No. 61/555,848 filed on Nov. 4, 2011, the contents of which are incorporated herein by reference in their entirety.

FIELD

The present invention relates to LRP6 constructs that bind to LRP6 receptor. The LRP6 constructs comprise at least one LRP6 binding moiety and a half-life extender molecule such that the LRP6 construct inhibit the Wnt signaling pathway without potentiation of the Wnt signal. The LRP6 constructs also have an increased half-life to provide more time for the therapeutic benefit.

BACKGROUND TO THE INVENTION

The Wnt/β-catenin pathway regulates diverse biological processes during development and tissue homeostasis through modulating the protein stability of β-catenin. The pathway has also been implicated in many human cancers (see Clevers et al., (2006) Cell 127:469-480; and Logan et al., (2004) Annu. Rev Cell Dev. Biol 20:781-810).

The Wnt signal is transduced across the plasma membrane through two distinct receptor types, the serpentine receptor Frizzled, and the single-transmembrane proteins LRP5 or LRP6. The Wnt proteins promote the assembly of the Frizzled-LRP5/6 signaling complex, and induce phosphorylation of the cytoplasmic PPPSPxS motifs of LRP5/6 by GSK3 and Casein Kinase I. Phosphorylated LRP5/6 bind to Axin and inactivate the β-catenin degradation complex. Stabilized β-catenin enters the nucleus, binds to the TCF family transcription factors, and turns on transcription.

The large extracellular domain of LRP5/6 contains four YWTD-type β-propeller regions that are each followed by an EGF-like domain, and the LDLR domain. Each propeller region contains six YWTD motifs that form a six-bladed β-propeller structure. Biochemical studies suggest that Wnt proteins physically interact with both Frizzled and LRP6 and induce formation of Frizzled-LRP6 signaling complex (Semenov et al., (2001) Curr. Biol 11, 951-961; Tamai, et al. (2000) Nature 407, 530-535). Besides Wnt proteins, the large extracellular domain of LRP5/6 binds to multiple secreted Wnt modulators, including Wnt antagonist, DKK1 and Sclerostin (SOST), and Wnt agonist R-Spondins.

Although antibodies to LRP6 have been identified, the therapeutic properties of IgG formatted molecules can be limited by several factors, including limited tissue penetration due to large size and poor vascularization of target tissues, such as tumors (Schmidt & Wittrup, (2009) Mol. Cancer Ther. 8, 2861-71). In addition, for oncology uses, an immunosuppressive tumor microenvironment can suppress Fc mediated effector function (Dougan & Dranoff, 2009, Curr Protocol Immunol Chapter 20: Unit 20.11). Hence, there is a need for new protein therapeutic formats. However, the therapeutic efficacy of recombinant proteins smaller than 50-60 kDa can be limited by short serum half-life due to, for example, renal clearance and endocytosis by endothelial cells.

Accordingly, there is a need for new LRP6 antibody formats and methods to prolong serum half life of these antibody formats to enable the generation of effective therapeutics. In particular, there is a need for new LRP6 antibody formats that inhibit the Wnt signaling pathway, especially to treat human cancer.

SUMMARY

This invention provides novel LRP6 constructs that inhibit Wnt signaling without potentiation of the Wnt signal and demonstrate and increased half life. Specifically, the invention provides LRP6 conjugates comprising at least one LRP6 binding moiety and at least one half-life extender such that the LRP6 construct binds to LRP6 and inhibits Wnt signaling without significant potentiation of the Wnt signal and has an increased half life (e.g., at least about 5 hours, at least 10 hours, at least 15 hours, at least 20 hours, at least 25 hours, at least 30 hours, at least 35 hours, at least 40 hours, or more).

Accordingly, in one aspect, the invention pertains to an isolated low density lipoprotein-related protein 6 (LRP6) construct comprising first and second LRP6 binding moieties that bind to LRP6, and a half-life extender molecule, wherein the half life extender molecule is selected from the group consisting of PEG, Fc and HSA, wherein the first and second LRP6 binding moieties are linked to the N- and C-termini of the half-life extender, wherein the LRP6 construct inhibits a canonical Wnt signal transduction pathway; and wherein the LRP6 construct displays no significant potentiation of a Wnt signal in the presence of unblocked LRP6 binding protein. In one embodiment, the LRP6 binding moieties are selected from the group consisting of antibodies, bispecific single chain Fv ($(scFv')_2$) molecules, single domain antibodies, diabodies, triabodies, hormones, Fab fragments, $F(ab')_2$ molecules, scFab fragments, and tandem scFv (taFv) fragments. In one embodiment, the LRP6 binding moieties are single chain Fv molecules (scFvs). In one embodiment, the LRP6 construct binds to more than one Propeller region of LRP6, wherein the Propeller region is selected from the group consisting of Propeller 1 and Propeller 3. In one embodiment, the first LRP6 binding moiety is linked to the N-terminal of the half-life extender and binds to the Propeller 1 region of LRP6, and the second LRP6 binding moiety is linked to the C-terminal of the half-life extender and binds to the Propeller 3 region of LRP6. In another embodiment, the first LRP6 binding moiety is linked to the C-terminal of the half-life extender and binds to the Propeller 1 region of LRP6, and the second LRP6 binding moiety is linked to the N-terminal of the half-life extender and binds to the Propeller 3 region of LRP6. In one embodiment, the LRP6 binding protein is a Wnt binding protein selected from the group consisting of Wnt 1, Wnt 3, and Wnt 3a. In one embodiment, the LRP6 binding moieties are linked to the N- and C-termini of the half-life extender via a linker selected from the group consisting of an Fc linker, a hinge linker, a Gly-Ser linker, an Ala linker, and a KTHT linker. In another embodiment, the LRP6 binding moieties are linked to the N- and C-termini of the half-life extender by direct fusion to the half-life extender. In one embodiment, the LRP6 construct inhibits phosphorylation of LRP6 as assessed by a Wnt ligand induced phosphorylation assay. In one embodiment, the LRP6 construct has the functional activity of depleting a cell population, inhibiting or reducing proliferation of a cell population, inhibiting or reducing secretion of inflammatory mediators from a cell population, inhibiting or reducing secretion of cytoplasmic granules from a cell population, wherein the cell population is selected from the group consisting of tumor cells, and Wnt dependent cells. In one embodiment, the LRP6 construct shows increased half-life of about 5 hours compared with the LRP6 binding moiety without a half-life extender.

In another aspect, the invention pertains to an isolated low density lipoprotein-related protein 6 (LRP6) construct comprising first and second LRP6 single chain Fv molecules (scFvs) that bind to LRP6, and a human serum albumin, wherein the first and second scFv molecules are linked to the N- and C-termini of the human serum albumin, wherein the LRP6 construct inhibits a canonical Wnt signal transduction pathway, and wherein the LRP6 construct displays no significant potentiation of a Wnt signal in the presence of an LRP6 binding protein. In one embodiment, the first LRP6 scFv is linked to the N-terminal of the human serum albumin and binds to the Propeller 1 region of LRP6, and the second LRP6 scFv is linked to the C-terminal of the human serum albumin and binds to the Propeller 3 region of LRP6. In another embodiment, the first LRP6 scFv is linked to the C-terminal of the human serum albumin and binds to the Propeller 1 region of LRP6, and the second LRP6 scFv is linked to the N-terminal of the human serum albumin and binds to the Propeller 3 region of LRP6. In one embodiment, the LRP6 binding protein is a Wnt binding protein selected from the group consisting of Wnt 1, Wnt 3, and Wnt 3a. In one embodiment, the first and second LRP6 scFvs are indirectly linked to the N- and C-termini of the human serum albumin via an attachment linker selected from the group consisting of an Fc linker, a hinge linker, a Gly-Ser linker, an Ala linker, and a KTHT linker. In another embodiment, the first and second LRP6 scFvs are directly linked to the N- and C-termini of the human serum albumin by direct fusion to the human serum albumin. In one embodiment, the human serum albumin is selected from the group consisting of a mutant human serum albumin, or a fragment of a human serum albumin. In one embodiment, the mutant human serum albumin comprises mutations C34S and N503Q. In one embodiment, the fragment of human serum albumin comprises at least one domain of human serum albumin selected from the group consisting of DI, DII, DIII, and DIV. In one embodiment, the scFv fragment comprises at least one amino acid mutation that improves stability of the scFv compared with the unmutated scFv fragment, wherein the amino acid mutation is selected from FIGS. 32-35. In one embodiment, the scFv fragment binds to the Propeller 1 region of LRP6 and comprises at least one amino acid mutation that improves stability of the scFv compared with the unmutated scFv fragment, wherein the amino acid mutation is in a selected from the group consisting of I34M, and S49A. In another embodiment, the scFv fragment binds to the Propeller 3 region of LRP6 and comprises at least one amino acid mutation that improves stability of the scFv compared with the unmutated scFv fragment, wherein the amino acid mutation is M100F. In yet another embodiment, the scFv fragment binds to the Propeller 1 region of LRP6 and comprises at least one amino acid mutation that improves stability of the scFv compared with the unmutated scFv fragment, wherein the amino acid mutation is in a selected from the group consisting of I34M, and S49A; and an scFv fragment that binds to the Propeller 3 region of LRP6 and comprises at least one amino acid mutation that improves stability of the scFv compared with the unmutated scFv fragment, wherein the amino acid mutation is M100F. In one embodiment, the LRP6 construct inhibits phosphorylation of LRP6 as assessed by a Wnt ligand induced phosphorylation assay. In another embodiment, the LRP6 construct has the functional activity of depleting a cell population, inhibiting or reducing proliferation of a cell population, inhibiting or reducing secretion of inflammatory mediators from a cell population, inhibiting or reducing secretion of cytoplasmic granules from a cell population, wherein the cell population is selected from the group consisting of tumor cells, and Wnt dependent cells. In one embodiment, the LRP6 construct shows increased half-life of about 5 hours compared with the LRP6 binding moiety without a half-life extender.

In another aspect, the invention pertains to an isolated low density lipoprotein-related protein 6 (LRP6) construct comprising SEQ ID NO 293; or an amino acid sequence comprising at least 95% sequence identity with SEQ ID NO: 293.

In another aspect, the invention pertains to an isolated low density lipoprotein-related protein 6 (LRP6) construct comprising SEQ ID NO: 295; or an amino acid sequence comprising at least 95% sequence identity with SEQ ID NO: 295.

In another aspect, the invention pertains to a nucleic acid comprising a nucleotide sequence encoding a low density lipoprotein-related protein 6 (LRP6).

In another aspect, the invention pertains to a nucleic acid comprising a nucleotide sequence encoding a low density lipoprotein-related protein 6 (LRP6) construct comprising a SEQ ID NO: 293; or a nucleotide sequence comprising at least 98% sequence identity with SEQ ID NO: 293.

In another aspect, the invention pertains to a nucleic acid comprising a nucleotide sequence encoding a low density lipoprotein-related protein 6 (LRP6) construct comprising a SEQ ID NO: 295; or a nucleotide sequence comprising at least 98% sequence identity with SEQ ID NO: 295.

In another aspect, the invention pertains to a vector comprising the nucleic acid encoding the LRP6 construct.

In another aspect, the invention pertains to a pharmaceutical composition comprising a low density lipoprotein-related protein 6 (LRP6) construct and a pharmaceutically acceptable carrier.

In another aspect, the invention pertains to a method of making a low density lipoprotein-related protein 6 (LRP6) construct of claim 1 comprising: (a) providing a first single chain Fv molecule that binds to a first binding site of an LRP6 target receptor; (b) providing a second single chain Fv molecule that binds to a second binding site of an LRP6 target receptor; and (c) directly or indirectly linking the first scFv and the second scFv to a half-life extender molecule, wherein the LRP6 construct inhibits a canonical Wnt signal transduction pathway, and wherein the LRP6 construct displays no significant potentiation of a Wnt signal in the presence of an LRP6 binding protein.

In another aspect, the invention pertains to a method of treating a disease mediated by a canonical Wnt signaling pathway using a low density lipoprotein-related protein 6 (LRP6) construct.

In another aspect, the invention pertains to a method of treating a cancer comprising selecting a subject having an LRP6 expressing cancer by administering to a subject in need thereof an effective amount of a composition comprising a low density lipoprotein-related protein 6 (LRP6) construct. In one embodiment, the subject is a human.

In another aspect, the invention pertains to a method of treating a cancer comprising selecting a subject having an LRP6 expressing cancer, administering to a subject in need thereof an effective amount of a composition comprising a low density lipoprotein-related protein 6 (LRP6) construct of any one of the previous claims, wherein the cancer is selected from the group consisting of breast cancer, lung cancer, multiple myeloma, ovarian cancer, liver cancer, liver cancer gastric cancer, prostate cancer, acute myeloid leukemia, chronic myeloid leukemia, osteosarcoma, squamous cell carcinoma, and melanoma.

In another aspect, the invention pertains to use of a low density lipoprotein-related protein 6 (LRP6) construct of any one of the previous claims in the manufacture of a medicament for the treatment of a cancer selected from the group consisting of breast cancer, lung cancer, multiple myeloma, ovarian cancer, liver cancer, liver cancer gastric cancer, prostate cancer, acute myeloid leukemia, chronic myeloid leukemia, osteosarcoma, squamous cell carcinoma, and melanoma.

In another aspect, the invention pertains to a low density lipoprotein-related protein 6 (LRP6) construct LRP6 for use as a medicament. In another aspect, the invention pertains to a low density lipoprotein-related protein 6 (LRP6) construct having SEQ ID NO: 293 for use in treating a cancer mediated by a canonical Wnt signaling pathway. In another aspect, the invention pertains to a low density lipoprotein-related protein 6 (LRP6) construct having SEQ ID NO: 295 for use in treating a cancer mediated by a canonical Wnt signaling pathway. In another aspect, the invention pertains to a low density lipoprotein-related protein 6 (LRP6) construct having SEQ ID NO: 293 for use as a drug. In another aspect, the invention pertains to a low density lipoprotein-related protein 6 (LRP6) construct having SEQ ID NO: 295 for use as a drug.

BRIEF DESCRIPTION OF FIGURES

FIG. 2 shows the potency of anti-LRP6 bispecific serum albumin fusions and bispecific LRP6 antibody half molecules to inhibit Wnt1 and Wnt3a stimulated signaling in STF reporter gene assays;

FIG. 9 shows several anti-LRP6 fusion molecules;

FIG. 11 shows the thermostability measurements of HSA fusion based biparatopic molecules;

FIG. 14 shows the thermostability of HSA fusion based biparatopic molecules as determined by DSF;

FIG. 16 shows aggregation of anti-LRP6 HSA fusion based biparatopic molecules by analytical SEC after multiple freeze-and-thaws (FTs);

FIG. 25 shows several anti-LRP6 Fc fusion molecules;

FIG. 32 is a table showing the effect of single mutations in MOR06475 scFv on Tm.

FIG. 33 is a table showing the effect of single mutations in MOR08168 scfv on Tm;

FIGS. 34A-B are tables showing the effect of double mutations in MOR08168 scFv on Tm in material expressed in both bacterial and mammalian systems; and FIG. 35 is a table summarizing the binding and functional activities of the wild type and single/double mutated versions of MOR06475 and MOR08168 scFvs in ELISA, Proteon affinity and STF reporter gene assays.

DETAILED DESCRIPTION

Definitions

Figure 1A:
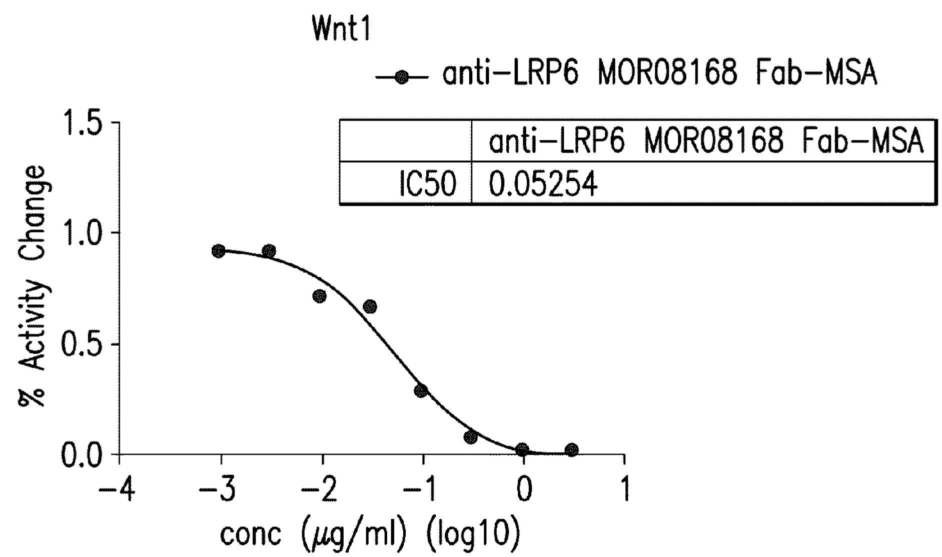
FIGS. 1A-J are graphs showing the activity of anti-LRP6 mouse serum albumin fusion molecules in HEK293 STF cells (gene reporter assay) transiently expressing Wnt1 or Wnt3a ligands. The data show that anti-LRP6 MSA fusion molecules block either Wnt1 or Wnt3a signaling.
Figure 1B:
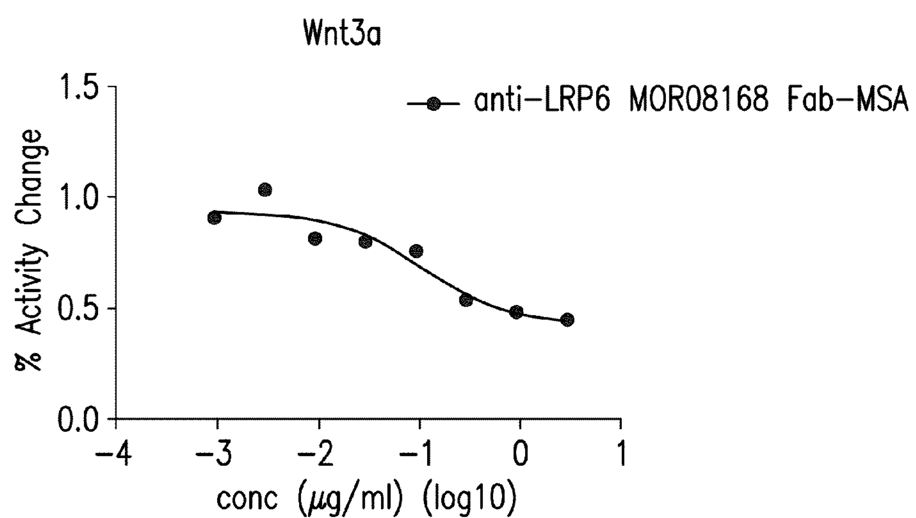
Figure 1C:
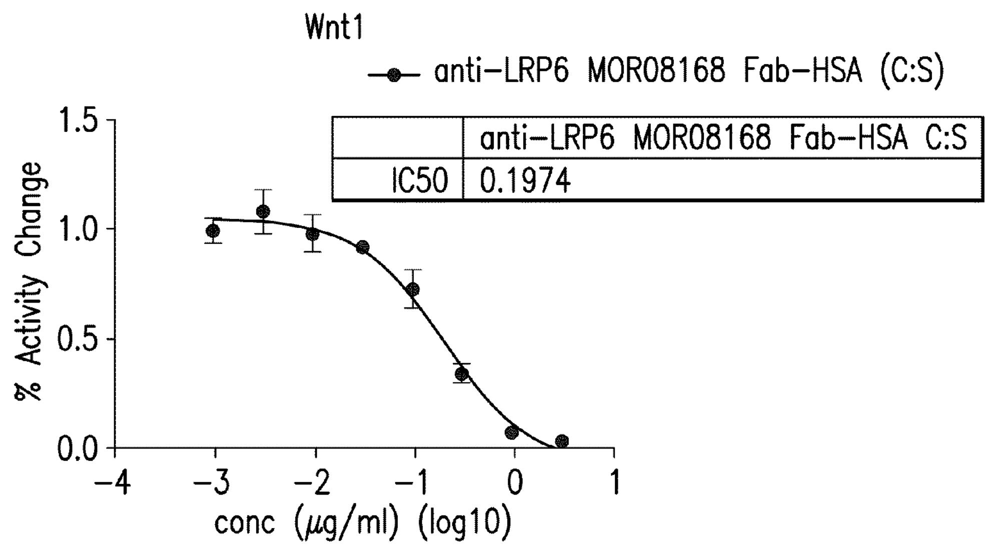
Figure 1D:
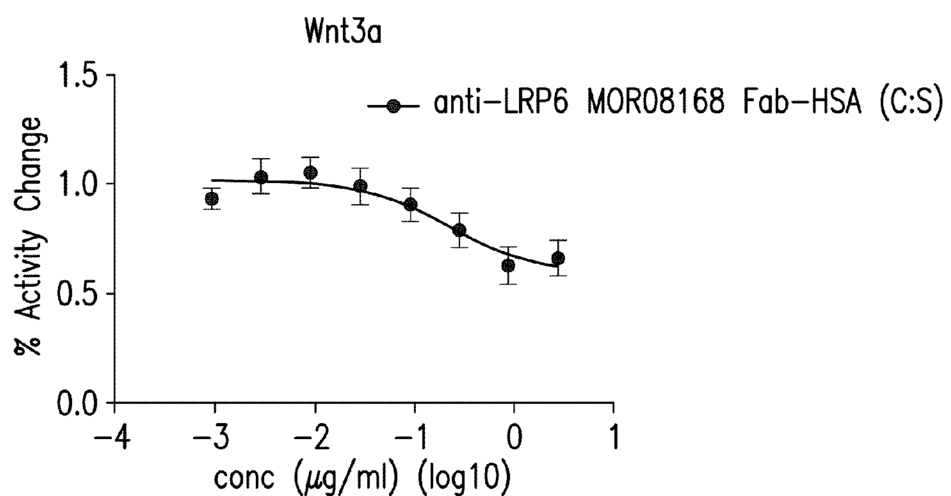
Figure 1E:
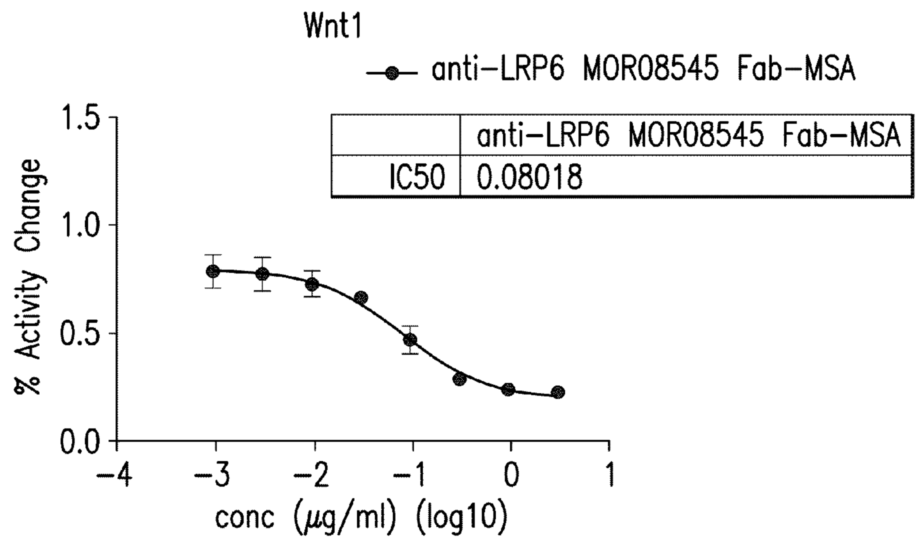
Figure 1F:
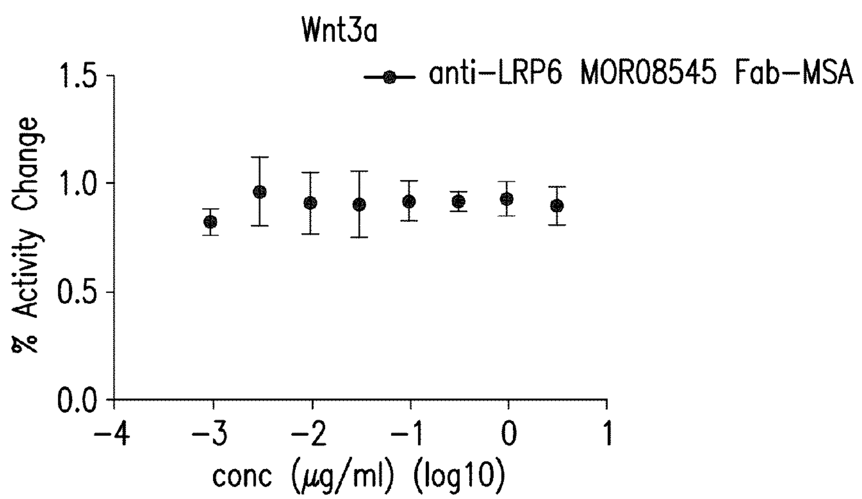
Figure 1G:
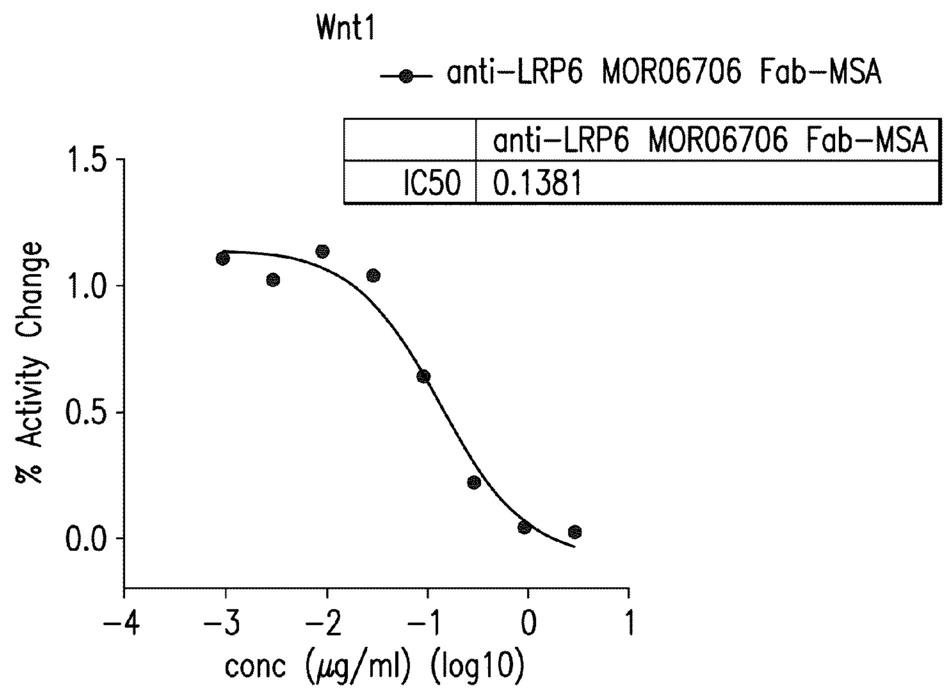
Figure 1H:
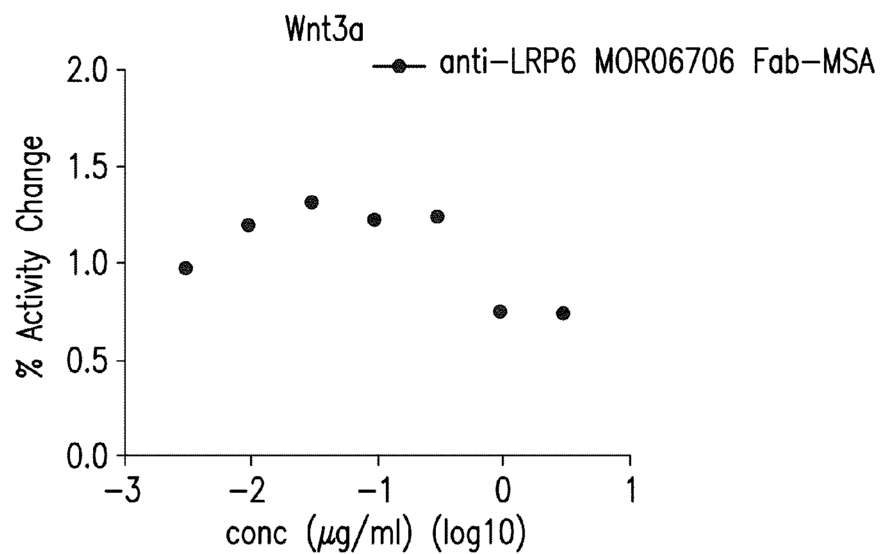
Figure 1I:
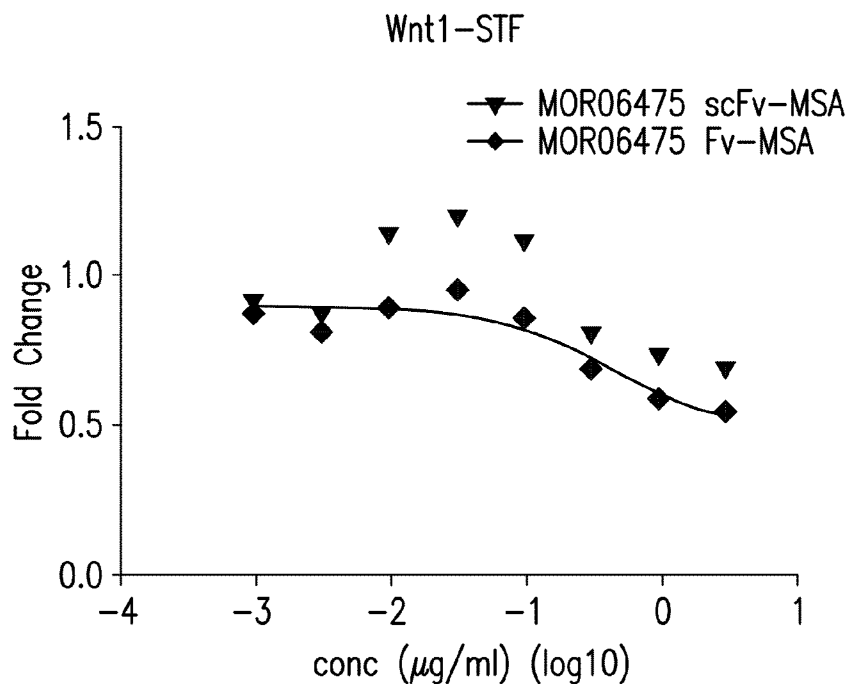
Figure 1J:
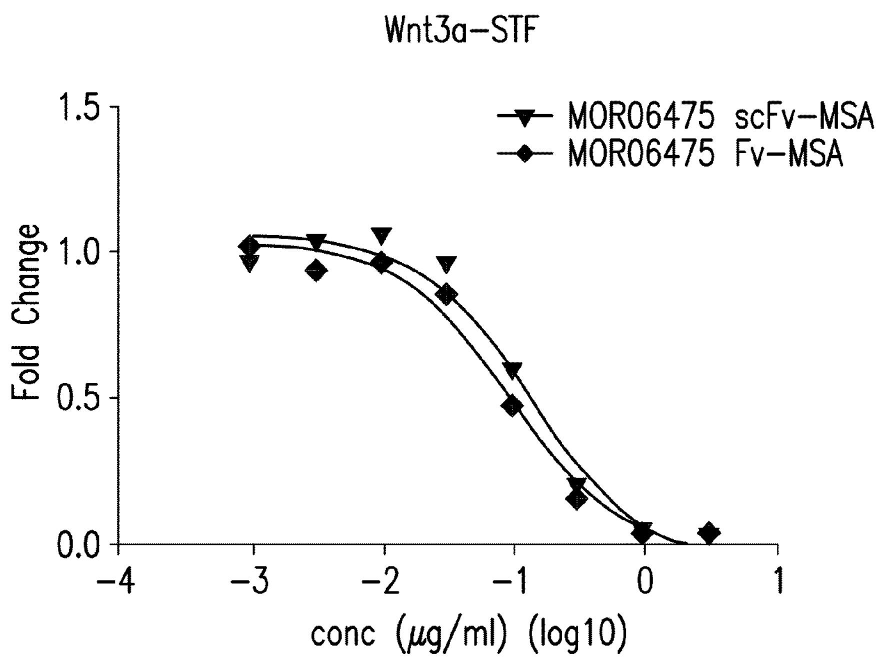

In order that the present invention may be more readily understood, certain terms are first defined. Additional definitions are set forth throughout the detailed description.

The term "LRP6" refers to human low density lipoprotein-related protein 6 as defined in Accession No. NP002327.

The phrase "LRP6 construct" as used herein refers to a molecule comprising at least one LRP6 binding moiety and at least one half-life extender molecule. The LRP6 binding moiety can be any molecule that binds to at least one region of LRP6, such as the Propeller region of LRP6. The LRP6 construct binds to LRP6 and inhibits the Wnt signaling pathway without potentiation of the Wnt signal. In addition, the LRP6 construct demonstrates increased in vitro and in vivo half-life compared with the LRP6 binding moiety alone (e.g., by at least 5 hours, at least 10 hours, at least 15 hours, at least 20 hours, at least 25 hours, at least 30 hours, at least 35 hours, at least 40 hours, or more).

The term "LRP6 binding moiety" refers to any molecule that specifically binds to an LRP6 target epitope, antigen, ligand, or receptor. LRP6 binding moieties include but are not limited to antibodies (e.g., monoclonal, polyclonal, recombinant, humanized, and chimeric antibodies), antibody fragments (e.g., Fab fragments, Fab'$_2$, scFv antibodies, SMIP, domain antibodies, diabodies, minibodies, scFv-Fc, affibodies, nanobodies, and domain antibodies), receptors, ligands, aptamers, and other molecules having a known binding partner.

The term "antibody" as used herein refers to whole antibodies that interact with (e.g., by binding, steric hinderance, stabilizing/destabilizing, spatial distribution) an LRP6 epitope and inhibit signal transduction. A naturally occurring "antibody" is a glycoprotein comprising at least two heavy (H) chains and two light (L) chains inter-connected by disulfide bonds. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (Clq) of the classical complement system.

For example, the antibody can be a human antibody, a humanized antibody, a bispecific antibody, a chimeric antibody, or a protein scaffold with antibody-like properties, such as fibronectin or ankyrin repeats. The antibody can have any of the following isotypes: IgG (e.g., IgG1, IgG2, IgG3, and IgG4), IgM, IgA (e.g., IgA1, IgA2, and IgAsec), IgD, or IgE.

Both the light and heavy chains are divided into regions of structural and functional homology. The terms "constant" and "variable" are used functionally. In this regard, it will be appreciated that the variable domains of both the light (VL) and heavy (VH) chain portions determine antigen recognition and specificity. Conversely, the constant domains of the light chain (CL) and the heavy chain (CH1, CH2 or CH3) confer important biological properties such as secretion, transplacental mobility, Fc receptor binding, complement binding, and the like. By convention the numbering of the constant region domains increases as they become more distal from the antigen binding site or amino-terminus of the antibody. The N-terminus is a variable region and at the C-terminus is a constant region; the CH3 and CL domains actually comprise the carboxy-terminus of the heavy and light chain, respectively.

The term "antibody fragment" as used herein, refers to one or more fragments of an antibody that retain the ability to specifically interact with (e.g., by binding, steric hinderance, stabilizing/destabilizing, spatial distribution) an LRP6 epitope and inhibit signal transduction. The epitope binding function of an antibody can be performed by fragments of a full-length antibody. Examples of binding fragments encompassed within the term "antigen-binding portion" of an antibody include but are not limited to: (i) a Fab fragment, a monovalent fragment consisting of the VL, VH, CL, and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a scFab consisting of VL, VH, CL and CH1 domains, (v) a dAb including VH and VL domains; (vi) a dAb fragment (Ward et al, Nature 341:544-546 (1989)), which consists of a VH domain; (vii) a dAb which consists of a VH or a VL domain; (viii) an isolated complementarity determining region (CDR); and (ix) a combination of two or more isolated CDRs which may optionally be joined by a synthetic linker. These antibody fragments are obtained using conventional techniques known to those with skill in the art, and the fragments are screened for utility in the same manner as are intact antibodies. Antibody fragments can be produced by recombinant DNA techniques, or by enzymatic or chemical cleavage of intact immunoglobulins.

The term "scFv" as used herein, refers to VL and VH joined together using recombinant methods, or by a synthetic linker that enables them to be made as a single protein chain in which the VL and VH regions pair to form monovalent molecules (known as single chain Fv (scFv); see e.g., Bird et al, Science 242:423-426 (1988) and Huston et al, Proc. Natl. Acad. Sci USA 85:5879-5883 (1988)).

The term "half-life extender molecule" refers to a biological or chemical entity that imparts additional functionality to a molecule to which it is attached. In a particular embodiment, the half-life extender is a polypeptide, e.g., human serum albumin (HSA), or a chemical entity, e.g., polyethylene gycol (PEG) which increases the half-life of the LRP6 binding moieties. Half-life extender molecules can increase the half-life of an LRP6 binding moiety by at least about 5 hours, at least 10 hours, at least 15 hours, at least 20 hours, at least 25 hours, at least 30 hours, at least 35 hours, at least 40 hours, or more as determined by the assays disclosed herein (e.g., mRNA expression levels of Axin2).

The phrase "Wnt signaling pathway" as used herein refers to the canonical Wnt pathway in which members of the Wnt family of secreted protein ligands bind a receptor complex of LRP and Frizzled (FZD) allowing β-catenin to be translocated into the nucleus, interact with the LEF/TCF transcription factors and activate target gene expression. The Wnt signaling pathway can be measured using a Wnt reporter gene assay or other measure of Wnt directed signaling (e.g., LRP6 phosphorylation, β-catenin stabilization and nuclear translocation, cellular proliferation/survival) as described herein.

The phrase "Wnt 1 signaling pathway" refers to a canonical Wnt pathway that is activated by LRP6 interacting with the Wnt1 ligand and the class of Wnt1 binding ligands, such as Wnt2, Wnt6, Wnt7a, Wnt7b, Wnt9a, Wnt10a, or Wnt10b.

The phrase "Wnt 3 signaling pathway" refers to a canonical Wnt pathway that is activated by LRP6 interacting with the Wnt3 or a Wnt3a ligand.

The phrase "isolated LRP6 construct", as used herein, refers to an LRP6 construct that is substantially free of other LRP6 constructs having different antigenic specificities (e.g., an isolated LRP6 construct that specifically binds LRP6 is substantially free of constructs that specifically bind antigens other than LRP6). Moreover, an isolated LRP6 construct may be substantially free of other cellular material and/or chemicals. An isolated LRP6 construct that specifically binds LRP6 may, however, have cross-reactivity to other antigens, such as LRP6 molecules from other species. The phrases "monoclonal antibody" or "monoclonal antibody composition" as used herein refers to polypeptides, including antibodies, antibody fragments, bispecific antibodies, etc. that have substantially identical to amino acid sequence or are derived from the same genetic source. This term also includes preparations of antibody molecules of single molecular composition. A monoclonal antibody composition displays a single binding specificity and affinity for a particular epitope.

The phrase "human antibody", as used herein, includes antibodies having variable regions in which both the framework and CDR regions are derived from sequences of human origin. Furthermore, if the antibody contains a constant region, the constant region also is derived from such human sequences, e.g., human germline sequences, or mutated versions of human germline sequences or antibody containing consensus framework sequences derived from human framework sequences analysis, for example, as described in Knappik, et al. (2000. J Mol Biol 296, 57-86). The structures and locations of immunoglobulin variable domains, e.g., CDRs, may be defined using well known numbering schemes, e.g., the Kabat numbering scheme, the Chothia numbering scheme, or a combination of Kabat and Chothia (see, e.g., Sequences of Proteins of Immunological Interest, U.S. Department of Health and Human Services (1991), eds. Kabat et al.; Al Lazikani et al., (1997) J. Mol. Bio. 273:927 948); Kabat et al., (1991) Sequences of Proteins of Immunological Interest, 5th edit., NIH Publication no. 91-3242 U.S. Department of Health and Human Services; Chothia et al., (1987) J. Mol. Biol. 196:901-917; Chothia et al., (1989) Nature 342:877-883; and Al-Lazikani et al., (1997) J. Mol. Biol. 273:927-948.

The human antibodies and human antibody fragments may include amino acid residues not encoded by human sequences (e.g., mutations introduced by random or site-specific mutagenesis in vitro or by somatic mutation in vivo, or a conservative substitution to promote stability or manufacturing). However, the terms "human antibody" and "human antibody fragments", as used herein, is not intended to include antibodies in which CDR sequences derived from the germline of another mammalian species, such as a mouse, have been grafted onto human framework sequences.

The phrase "recombinant human antibody", as used herein, includes all human antibodies that are prepared, expressed, created or isolated by recombinant means, such as antibodies isolated from an animal (e.g., a mouse) that is transgenic or transchromosomal for human immunoglobulin genes or a hybridoma prepared therefrom, antibodies isolated from a host cell transformed to express the human antibody, e.g., from a transfectoma, antibodies isolated from a recombinant, combinatorial human antibody library, and antibodies prepared, expressed, created or isolated by any other means that involve splicing of all or a portion of a human immunoglobulin gene, sequences to other DNA sequences. Such recombinant human antibodies have variable regions in which the framework and CDR regions are derived from human germline immunoglobulin sequences. In certain embodiments, however, such recombinant human antibodies can be subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

The term "attachment linker" as used herein refers to a peptide linker that consists of amino acids such as alanine, glycine and serine residues used alone or in combination, to link at least one LRP6 binding moiety (e.g., scFv) to a half-life extender. In one embodiment, the linker is a Gly/Ser linker and comprises the amino acid sequence (Gly-Gly-Ser)$_2$, i.e., (Gly$_2$ Ser)$_n$ where n is a positive integer equal to or greater than 1. For example, n=1, n=2, n=3. n=4, n=5 and n=6, n=7, n=8, n=9 and n=10. In one embodiment, the linkers include, but are not limited to, (Gly$_4$ Ser)$_4$ or (Gly$_4$Ser)$_3$. In another embodiment, the linkers Glu and Lys residues interspersed within the Gly-Ser linkers for better solubility. In another embodiment, the linkers include multiple repeats of (Gly$_2$Ser), (GlySer) or (Gly$_3$Ser). In another embodiment, the linkers include combinations and multiples of (Gly$_3$Ser)+(Gly$_4$Ser)+(GlySer). In another embodiment, Ser can be replaced with Ala e.g., (Gly$_4$Ala) or (Gly$_3$Ala). In another embodiment, the linker comprises any combination of Gly, Ser and Pro. In yet another embodiment, the linker comprises the motif (GluAlaAlaAlaLys)$_n$, where n is a positive integer equal to or greater than 1. In another embodiment, the linker is an Ala linker comprising amino acid sequence Ala-Ala-X$_n$, where X can be any amino acid (e.g., Ala, Gly, Ser, Glu, or Val) and n is an integer from 1-20. In another embodiment, no attachment linker is used to link at least one LRP6 binding moiety (e.g., scFv) is to a half-life extender.

The term "interdomain linker" as used herein refers to a peptide linker that consists of amino acids such as alanine, glycine and serine residues used alone or in combination, to link multiple LRP6 binding moieties together. In one embodiment, the linker is a Gly/Ser linker and comprises the amino acid sequence (Gly-Gly-Ser)$_2$, i.e., (Gly$_2$ Ser)$_n$ where n is a positive integer equal to or greater than 1. For example, n=1, n=2, n=3. n=4, n=5 and n=6, n=7, n=8, n=9 and n=10. In one embodiment, the linkers include, but are not limited to, (Gly$_4$ Ser)$_4$ or (Gly$_4$Ser)$_3$. In another embodiment, the linkers Glu and Lys residues interspersed within the Gly-Ser linkers for better solubility. In another embodiment, the linkers include multiple repeats of (Gly$_2$Ser), (GlySer) or (Gly$_3$Ser). In another embodiment, the linkers include combinations and multiples of (Gly$_3$Ser)+(Gly$_4$Ser)+(GlySer). In another embodiment, Ser can be replaced with Ala e.g., (Gly$_4$Ala) or (Gly$_3$Ala). In another embodiment, the linker comprises any combination of Gly, Ser and Pro. In yet another embodiment, the linker comprises the motif (GluAlaAlaAlaLys)$_n$, where n is a positive integer equal to or greater than 1. In another embodiment, the linker is an Ala linker comprising amino acid sequence Ala-Ala-X$_n$, where X can be any amino acid (e.g., Ala, Gly, Ser, Glu, or Val) and n is an integer from 1-20.

The term "binding site" as used herein comprises an area on the LRP6 target receptor to which the LRP6 binding moiety selectively binds. For example, the binding sites on LRP6 include the β-propeller 1 binding domain, β-propeller 2 binding domain, β-propeller 3 binding domain, and β-propeller 4 binding domain.

The term "epitope" as used herein refers to any determinant capable of binding with high affinity to an immunoglobulin. An epitope is a region of the LRP6 receptor that is bound by an LRP6 binding moiety (e.g., scFv). Regions of a given polypeptide (e.g., LRP6) that include an epitope can be identified using any number of epitope mapping techniques, well known in the art. See, e.g., Epitope Mapping Protocols in Methods in Molecular Biology, Vol. 66 (Glenn E. Morris, Ed., 1996) Humana Press, Totowa, N.J. For example, linear epitopes may be determined by e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al., (1984) Proc. Natl. Acad. Sci. USA 8:3998-4002; Geysen et al., (1985) Proc. Natl. Acad. Sci. USA 82:78-182; Geysen et al., (1986) Mol. Immunol. 23:709-715. Similarly, conformational epitopes are readily identified by determining spatial conformation of amino acids such as by, e.g., x-ray crystallography and two-dimensional nuclear magnetic resonance. See, e.g., Epitope Mapping Protocols, supra. Antigenic regions of proteins can also be identified using standard antigenicity and hydropathy plots, such as those calculated using, e.g., the Omiga version 1.0 software program available from the Oxford Molecular Group. This computer program employs the Hopp/Woods method, Hopp et al., (1981) Proc. Natl. Acad. Sci USA 78:3824-3828; for determining antigenicity profiles, and the Kyte-Doolittle technique, Kyte et al., (1982) J. MoI. Biol. 157:105-132; for hydropathy plots.

The term "specific binding" between two entities means a binding with an equilibrium constant ($K_A$) ($k_{on}/k_{off}$) of at least $10^2M^{-1}$, at least $5\times10^2M^{-1}$, at least $10^3M^{-1}$, at least $5\times10^3 M^{-1}$, at least $10^4M^{-1}$ at least $5\times10^4M^{-1}$, at least $10^5M^{-1}$, at least $5\times10^5M^{-1}$, at least $10^6M^{-1}$, at least $5\times10^6M^{-1}$, at least $10^7M^{-1}$, at least $5\times10^7M^{-1}$, at least $10^8M^{-1}$, at least $5\times10^8 M^{-1}$, at least $10^9M^{-1}$, at least $5\times10^9M^{-1}$, at least $10^{10}M^{-1}$, at least $5\times10^{10}M^{-1}$ at least $10^{11}M^{-1}$, at least $5\times10^{11}M^{-1}$, at least $10^{12}M^{-1}$, at least $5\times10^{12}M^{-1}$, at least $10^{13}M^{-1}$, at least $5\times10^{13}$ $M^{-1}$, at least $10^{14}M^{-1}$, at least $5\times10^{14}M^{-1}$, at least $10^{15}M^{-1}$, or at least $5\times10^{15}M^{-1}$.

The phrase "specifically (or selectively) binds" refers to a binding reaction between an LRP6 binding moiety and its cognate antigen (e.g., a human LRP6) that is determinative of the presence of a cognate antigen in a heterogeneous population of proteins and other biologics. In addition to the equilibrium constant ($K_A$) noted above, an LRP6 binding moiety typically also has a dissociation rate constant ($K_D$) ($k_{off}/k_{on}$) of less than $5\times10^{-2}$M, less than $10^{-2}$M, less than $5\times10^{-3}$M, less than $10^{-3}$M, less than $5\times10^{-4}$M, less than $10^{-4}$M, less than $5\times10^{-5}$M, less than $10^{-5}$M, less than $5\times10^{-6}$M, less than $10^{-6}$M, less than $5\times10^{-7}$M, less than $10^{-7}$M, less than $5\times10^{-8}$M, less than $10^{-8}$M, less than $5\times10^{-9}$M, less than $10^{-9}$M, less than $5\times10^{-10}$M, less than $10^{-10}$M, less than $5\times10^{-11}$M, less than $10^{-11}$M, less than $5\times10^{-12}$M, less than $10^{-12}$M, less than $5\times10^{-13}$M, less than $10^{-13}$M, less than $5\times10^{-14}$M, less than $10^{-14}$M, less than $5\times10^{-15}$M, or less than $10^{-15}$M or lower, and binds to LRP6 with an affinity that is at least two-fold greater than its affinity for binding to a non-specific antigen. In one embodiment, the LRP6 binding moiety has dissociation constant ($K_a$) of less than 3000 pM, less than 2500 pM, less than 2000 pM, less than 1500 pM, less than 1000 pM, less than 750 pM, less than 500 pM, less than 250 pM, less than 200 pM, less than 150 pM, less than 100 pM, less than 75 pM, less than 10 pM, less than 1 pM as assessed using a method described herein or known to one of skill in the art (e.g., a BIAcore assay, ELISA, FACS, SET) (Biacore International AB, Uppsala, Sweden).

The term "$K_{assoc}$" or "$K_a$", as used herein, refers to the association rate of a particular LRP6 binding moiety-antigen interaction, whereas the term "$K_{dis}$" or "$K_d$," as used herein, refers to the dissociation rate of a particular LRP6 binding moiety-antigen interaction. The term "$K_D$", as used herein, refers to the dissociation constant, which is obtained from the ratio of $K_d$ to $K_a$ (i.e. $K_d/K_a$) and is expressed as a molar concentration (M). $K_D$ values for LRP6 binding moieties such as LRP6 antibodies or fragments thereof can be determined using methods well established in the art. A method for determining the $K_D$ of an antibody is by using surface plasmon resonance, or using a biosensor system such as a Biacore® system.

The term "affinity" as used herein refers to the strength of interaction between LRP6 binding moiety and antigen at single antigenic sites. Within each antigenic site, the variable region of the antibody "arm" interacts through weak non-covalent forces with antigen at numerous sites; the more interactions, the stronger the affinity.

The term "avidity" as used herein refers to an informative measure of the overall stability or strength of the LRP6 binding moiety-LRP6 antigen complex. It is controlled by three major factors: antibody epitope affinity; the valence of both the antigen and antibody; and the structural arrangement of the interacting parts. Ultimately these factors define the specificity of the antibody, that is, the likelihood that the particular antibody is binding to a precise antigen epitope.

The phrase "inhibit" as used herein refers to an LRP6 construct that binds with LRP6 and reduces, decreases the biological activity of canonical Wnt signaling, e.g., reduces, decreases LRP6 induced signaling activity in a Wnt reporter gene assay, or a phospho LRP6 assay. Examples of assays are described in more details in the examples below. In some embodiments, the LRP6 construct reduces, decreases or inhibits LRP6 induced activity as measured in a Wnt reporter gene assay at an $IC_{50}$ of 10 nM or less, 1 nM or less, or 100 pM or less, 10 pM, 1 pM, 0.5 pM, 0.1 pM. In some embodiments, the activities of the LRP6 constructs can be measured by binding to LRP6 using SET, ELISA, FACS, Scatchard at an $IC_{50}$ of 10 nM or less, 1 nM or less, 0.5 pM, or 100 pM or less.

The term "Wnt 1" as used herein refers to Wnt1, Wnt2, Wnt6, Wnt7a, Wnt7b, Wnt9a, Wnt10a, or Wnt10b.

The term "Wnt 3a" as used herein refers to Wnt3a and Wnt3.

The term "potentiate" as used herein refers to a process whereby the Wnt signal is activated and enhanced upon conversion of a fragment of an antibody to a full length IgG LRP6 antibody in the presence of a Wnt ligand. For example, a Wnt 1 Fab binds to the Propeller 1 region of the LRP6 receptor and blocks Wnt 1 pathway in absence of a Wnt ligand, e.g., Wnt 3. In the presence of a Wnt ligand, e.g., Wnt 3, the Wnt 1 Fab blocks signaling through the Wnt 1 pathway, but signal activation may occur through the Wnt 3 pathway, thereby producing a signal. When the Wnt 1 Fab is converted to a full length Wnt 1 IgG, the Wnt 1 IgG binds to the Propeller 1 regions of two LRP6 receptors and blocks the Wnt 1 pathway, however, in the presence of a Wnt ligand, e.g., Wnt 3; signal activation occurs through the Wnt 3 pathway and is also enhanced. While not required to provide a theory of action, one possible mechanism is that the IgG clusters together two or more LRP6 receptors by binding to the Propeller 1 regions of each LRP6 receptor, which in the presence of a Wnt 3 ligand results in a stronger signal through the Wnt 3 pathway.

Dimerization of the LRP6 receptors promotes Wnt signaling, perhaps through the increases avidity of the various interactions involving LRP6.

The reverse results are obtained with a Wnt 3 Fab that binds to the Propeller 3 region of the LRP6 receptor and blocks the Wnt 3 pathway. In the presence of a Wnt 1 ligand, the Wnt 3 Fab blocks the Wnt 3 pathway, but activates the Wnt 1 pathway to generate a signal. When the Wnt 3 Fab is converted to a full length Wnt 3 IgG, the Wnt 3 IgG binds to the Propeller 3 regions of two LRP6 receptors, and in the presence of a Wnt 1 ligand, inhibits signaling through the Wnt 1 pathway.

The term "no significant potentiation" or "avoids potentiation" refers to a Wnt signal that is not activated or enhanced compared with a control antibody or fragment thereof that binds to the same epitope. No significant potentiation can be at least 10% less than control antibody or fragment thereof, at least 20%, at least 30%, at least 40%, at least 50%, at least 60%, at least 70%, at least 80%, at least 90%, at least 100% less than then control antibody or fragment thereof.

The term "cluster" as used herein refers to any protein that gathers or groups together LRP6 receptors and potentiates Wnt signaling. Examples of such proteins include, but are not limited to, Wnt 1 ligands, Wnt 3a ligands and Wnt 3 ligands. These proteins can cause multimerization, e.g., dimerization of two endogenous LRP6 receptors. This dimerization may result in increased avidity due to increased interactions of LRP6, which in the presence of a Wnt ligand can potentiate a Wnt signal.

The phrase "conservatively modified variant" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid that encodes a polypeptide is implicit in each described sequence.

For polypeptide sequences, "conservatively modified variants" include individual substitutions, deletions or additions to a polypeptide sequence which result in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)). In some embodiments, the term "conservative sequence modifications" are used to refer to amino acid modifications that do not significantly affect or alter the binding characteristics of the antibody containing the amino acid sequence.

The terms "cross-block", "cross-blocked" and "cross-blocking" are used interchangeably herein to mean the ability of an LRP6 binding moiety e.g., an antibody or fragment to interfere with the binding of other antibodies to LRP6 in a standard competitive binding assay. The ability or extent to which an LRP6 binding moiety is able to interfere with the binding of another binding moiety to LRP6, and therefore whether it can be said to cross-block, can be determined using standard competition binding assays. One suitable assay involves the use of the Biacore technology (e.g. by using the BIAcore 3000 instrument (Biacore, Uppsala, Sweden)), which can measure the extent of interactions using surface plasmon resonance technology. Another assay for measuring cross-blocking uses an ELISA-based approach.

The term "optimized" as used herein refers to a nucleotide sequence has been altered to encode an amino acid sequence using codons that are preferred in the production cell or organism, generally a eukaryotic cell, for example, a cell of *Pichia*, a cell of *Trichoderma*, a Chinese Hamster Ovary cell (CHO) or a human cell. The optimized nucleotide sequence is engineered to retain completely or as much as possible the amino acid sequence originally encoded by the starting nucleotide sequence, which is also known as the "parental" sequence.

Standard assays to evaluate the binding ability of the antibodies toward antigens of various species are known in the art, including for example, ELISAs, western blots and RIAs. These standard assays are also suitable for the LRP6 constructs and are described in detail in the Examples. The binding kinetics (e.g., binding affinity) of the LRP6 constructs also can be assessed by standard assays known in the art, such as by Biacore analysis, or FACS relative affinity (Scatchard). Assays to evaluate the effects of the LRP6 constructs on functional properties of LRP6 (e.g., receptor binding assays, modulating the Wnt pathway) are described in further detail in the Examples.

Accordingly, an LRP6 construct that "inhibits" one or more of these LRP6 functional properties (e.g., biochemical, immunochemical, cellular, physiological or other biological activities, or the like) as determined according to methodologies known to the art and described herein, will be understood to relate to a statistically significant decrease in the particular activity relative to that seen in the absence of the LRP6 construct. An LRP6 construct that inhibits LRP6 activity affects such a statistically significant decrease by at least 10% of the measured parameter, by at least 50%, 80% or 90%, and in certain embodiments an LRP6 construct may inhibit greater than 95%, 98% or 99% of LRP6 functional activity.

The phrases "percent identical" or "percent identity," in the context of two or more nucleic acids or polypeptide sequences, refers to two or more sequences or subsequences that are the same. Two sequences are "substantially identical" if two sequences have a specified percentage of amino acid residues or nucleotides that are the same (i.e., 60% identity, optionally 65%, 70%, 75%, 80%, 85%, 90%, 95%, 98%, or 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well known in the art. Optimal alignment of sequences for comparison can be conducted, e.g., by the local homology algorithm of Smith and Waterman (1970) Adv. Appl. Math. 2:482c, by the homology alignment algorithm of Needleman and Wunsch (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff and Henikoff, (1989) Proc. Natl. Acad. Sci. USA 89:10915) alignments (B) of 50, expectation (E) of 10, M=5, N=−4, and a comparison of both strands.

The BLAST algorithm also performs a statistical analysis of the similarity between two sequences (see, e.g., Karlin and Altschul (1993) Proc. Natl. Acad. Sci. USA 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

The percent identity between two amino acid sequences can also be determined using the algorithm of E. Meyers and W. Miller (Comput. Appl. Biosci. 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol, Biol. 48:444-453 (1970)) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

Other than percentage of sequence identity noted above, another indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence.

The phrase "nucleic acid" is used herein interchangeably with the term "polynucleotide" and refers to deoxyribonucleotides or ribonucleotides and polymers thereof in either single- or double-stranded form. Unless otherwise indicated, a particular nucleic acid sequence also implicitly encompasses conservatively modified variants thereof (e.g., degenerate codon substitutions) and complementary sequences, as well as the sequence explicitly indicated. Specifically, as detailed below, degenerate codon substitutions may be achieved by generating sequences in which the third position of one or more selected (or all) codons is substituted with mixed-base and/or deoxyinosine residues (Batzer et al., (1991) Nucleic Acid Res. 19:5081; Ohtsuka et al., (1985) J. Biol. Chem. 260:2605-2608; and Rossolini et al., (1994) Mol. Cell. Probes 8:91-98).

The phrase "operably linked" refers to a functional relationship between two or more polynucleotide (e.g., DNA) segments. Typically, it refers to the functional relationship of a transcriptional regulatory sequence to a transcribed sequence. For example, a promoter or enhancer sequence is operably linked to a coding sequence if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

The terms "polypeptide" and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer. Unless otherwise indicated, a particular polypeptide sequence also implicitly encompasses conservatively modified variants thereof.

The term "subject" includes human and non-human animals. Non-human animals include all vertebrates, e.g., mammals and non-mammals, such as non-human primates, sheep, dog, cow, chickens, amphibians, and reptiles. Except when noted, the terms "patient" or "subject" are used herein interchangeably.

The term "anti-cancer agent" means any agent that can be used to treat a cell proliferative disorder such as cancer, including cytotoxic agents, chemotherapeutic agents, radiotherapy and radiotherapeutic agents, targeted anti-cancer agents, and immunotherapeutic agents.

The term "tumor" refers to neoplastic cell growth and proliferation, whether malignant or benign, and all pre-cancerous and cancerous cells and tissues.

The term "anti-tumor activity" means a reduction in the rate of tumor cell proliferation, viability, or metastatic activity. A possible way of showing anti-tumor activity is to show a decline in growth rate of abnormal cells that arises during therapy or tumor size stability or reduction. Such activity can be assessed using accepted in vitro or in vivo tumor models, including but not limited to xenograft models, allograft models, MMTV models, and other known models known in the art to investigate anti-tumor activity.

The term "malignancy" refers to a non-benign tumor or a cancer. As used herein, the term "cancer" includes a malignancy characterized by deregulated or uncontrolled cell growth. Exemplary cancers include: carcinomas, sarcomas, leukemias, and lymphomas. The term "cancer" includes primary malignant tumors (e.g., those whose cells have not migrated to sites in the subject's body other than the site of the original tumor) and secondary malignant tumors (e.g., those arising from metastasis, the migration of tumor cells to secondary sites that are different from the site of the original tumor).

Various aspects are described in further detail in the following sections and subsections.

LRP6 and the Wnt-Signaling Pathway

The invention pertains to LRP6 constructs and uses thereof. LRP6 constructs comprise at least one LRP6 binding moiety and at least one half-life extender molecule. These LRP6 constructs bind to at least one binding site on the LRP6 receptor and inhibit Wnt signaling without potentiation of the Wnt signal and aid in diseases associated with canonical Wnt signaling, e.g., cancer.

The Wnt signaling pathway is important in embryonic development and postnatal tissue maintenance. This is achieved by directing a specific set of genes that control temporal and spatial regulation of cell growth, movement and cell survival (reviewed in Barker and Clevers (2006) Nature Rev. 5:997). Proper regulation of this pathway is important for maintaining tissue homeostasis. Chronic activation of this pathway promotes uncontrolled cell growth and survival and can consequently drive the development of cell proliferative diseases, such as cancer. Alternatively, abnormal inhibition of this pathway can result in many disease states, for example loss of bone mass and other bone diseases. Wnt proteins initiate downstream signaling by interacting with a Frizzled receptor and one of two cell-surface receptors, which are members of the low-density-lipoprotein receptor (LDLR)-related proteins (LRPs): LRP5 and LRP6 (reviewed in He et al., (2004) Development 31:1663-1677).

The extracellular domains of LRP6 comprise three basic domains: 1) a YWTD (tyrosine, tryptophan, threonine, aspartic acid)-type β-propeller region, 2) an EGF (epidermal growth factor)-like domain, and 3) a LDLR type A (LA) domain.

The YWTD-type β-propeller region of LRP6 contains six YWTD repeats of 43-50 amino acid residues each and forms a six-bladed β-propeller structure. In LRP6, there are four YWTD-type β-propeller regions that are each followed by an EGF-like domain, which comprises about 40 amino acid residues with conserved cysteine residues, which in turn are followed by three LA domains. (Springer et al., (1998) J. Mol. Biol. 283:837-862; Jeon et al., (2001) Nat. Struct. Biol. 8:499-504). The β-propeller-EGF-like domains may bind extracellular ligands.

The extracellular domain of LRP6 is defined by amino acid residues 19 to 1246 and contains four β-propeller domains at amino acid residues 43-324, 352-627, 654-929, and 957-1250, which correspond to β-propeller regions 1, 2, 3 and 4, respectively. Propeller domains 1-2 include amino acids 19-629, and Propeller domains 3-4 include amino acids 631-1246.

Using phage-based panning, LRP6 antibodies have been identified that either inhibit or enhance Wnt signaling, as shown in the Examples. Two classes of LRP6 antagonistic antibodies have been identified. One class of antibodies specifically inhibits Wnt proteins represented by Wnt1, while the second class specifically inhibits Wnt proteins represented by Wnt3a. Epitope mapping experiments indicate that Wnt1-specific and Wnt3a-specific LRP6 antibodies bind to the first propeller and the third propeller of LRP6 respectively, suggesting that Wnt1 and Wnt3a proteins bind to different propellers of LRP6 (See International Serial No. PCT/EP2008/064821 filed Oct. 31, 2008; PCT/EP2011/057200, filed May 6, 2011; and PCT/EP2011/057202, filed May 6, 2011, the contents of which are incorporated herein by reference in their entirety). Additional characterization of the Propeller 3 domain of LRP6 identified residues in this domain responsible for interaction with the antibodies. Antibody binding sites within YWTD-EGF region of Propeller 3 were identified using hydrogen-deuterium exchange (HDx) mass spectrometry (MS) and correspond to a concave surface between blade 1 and 6 of Propeller 3 domain.

The above identified LRP6 antibodies or fragments thereof have been used to generate the LRP6 constructs of the invention.

LRP6 Binding Moieties

The two classes of anti-LRP6 antibodies have previously been described (PCT/EP2011/057200, filed May 6, 2011; and PCT/EP2011/057202, filed May 6, 2011, the contents of which are incorporated herein by reference in their entirety): one class binds to the first propeller region and inhibits Wnt1 class-specific signaling and a second class binds to the third propeller region and inhibits Wnt3 class-specific signaling.

1. Antibodies

In one embodiment, the LRP6 constructs are produced by using at least one antibody linked to an half-life extender such that the LRP6 construct binds to LRP6 and inhibits Wnt signaling without potentiation of the Wnt signal and displays an increased half-life in vitro and in vivo.

Antibodies include the IgG, IgA, IgM, IgD, and IgE isotypes. Antibodies or antibody fragments thereof, as used herein, contain one or more complementarity determining regions (CDR) or binding peptides that bind to target proteins, glycoproteins, or epitopes present on the exterior or in the interior of target cells.

TABLE 1

Examples of LRP6 Antibodies of the Present Invention

| SEQ ID NUMBER | Ab region | Sequence |
| --- | --- | --- |
| MOR08168 Prop1 | | |
| SEQ ID NO: 1 (Kabat) | HCDR1 | DYVIN |
| SEQ ID NO: 2 (Kabat) | HCDR2 | GISWSGVNTHYADSVKG |
| SEQ ID NO: 3 (Kabat) | HCDR3 | LGATANNIRYKFMDV |
| SEQ ID NO: 4 (Kabat) | LCDR1 | SGDSLRNKVY |
| SEQ ID NO: 5 (Kabat) | LCDR2 | KNNRPS |
| SEQ ID NO: 6 (Kabat) | LCDR3 | QSYDGQKSLV |
| SEQ ID NO: 7 (Chothia) | HCDR1 | GFTFSDY |
| SEQ ID NO: 8 (Chothia) | HCDR2 | SWSGVN |
| SEQ ID NO: 9 (Chothia) | HCDR3 | LGATANNIRYKFMDV |
| SEQ ID NO: 10 (Chothia) | LCDR1 | DSLRNK |
| SEQ ID NO: 11 (Chothia) | LCDR2 | KN |
| SEQ ID NO: 12 (Chothia) | LCDR3 | YDGQKSL |
| SEQ ID NO: 13 | VL | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVL |
| SEQ ID NO: 14 | VH | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSS |

TABLE 1-continued

Examples of LRP6 Antibodies of the Present Invention

| SEQ ID NUMBER | Ab region | Sequence |
|---|---|---|
| SEQ ID NO: 15 | DNA VL | GATATCGAACTGACCCAGCCGCCTTCAGTGAGCGTTGCACCAGGTCAGACCGCGCGTATCTCGTGTAGCGGC<br>GATTCTCTTCGTAATAAGGTTTATTGGTACCAGCAGAAACCCGGGCAGGCGCCAGTTCTTGTGATTTATAAGA<br>ATAATCGTCCCTCAGGCATCCCGGAACGCTTTAGCGGATCCAACAGCGGCAACACCGCGACCCTGACCATTAG<br>CGGCACTCAGGCGGAAGACGAAGCGGATTATTATTGCCAGTCTTATGATGGTCAGAAGTCTCTTGTGTTTGGC<br>GGCGGCACGAAGTTAACCGTCCTA |
| SEQ ID NO: 16 | DNA VH | CAGGTGCAATTGGTGGAAAGCGGCGGCGGCCTGGTGCAACCGGGCGGCAGCCTGCGTCTGAGCTGCGCGGC<br>CTCCGGATTTACCTTTTCTGATTATGTTATTAATTGGGTGCGCCAAGCCCCTGGGAAGGGTCTCGAGTGGGTG<br>AGCGGTATTTCTTGGTCTGGTGTTAATACTCATTATGCTGATTCTGTTAAGGGTCGTTTTACCATTTCACGTGAT<br>AATTCGAAAAACACCCTGTATCTGCAAATGAACAGCCTGCGTGCGGAAGATACGGCCGTGTATTATTGCGCGC<br>GTCTTGGTGCTACTGCTAATAATATTCGTTATAAGTTTATGGATGTTTGGGGCCAAGGCACCCTGGTGACGGT<br>TAGCTCA |
| SEQ ID NO: 17 | Light Lambda | DIELTQPPSVSVAPGQTARISCSGDSLRNKVYWYQQKPGQAPVLVIYKNNRPSGIPERFSGSNSGNTATLTISGTQA<br>EDEADYYCQSYDGQKSLVFGGGTKLTVLGQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTVEKTVAPTECS |
| SEQ ID NO: 18 | Heavy IgG1<br>LALA | QVQLVESGGGLVQPGGSLRLSCAASGFTFSDYVINWVRQAPGKGLEWVSGISWSGVNTHYADSVKGRFTISRDN<br>SKNTLYLQMNSLRAEDTAVYYCARLGATANNIRYKFMDVWGQGTLVTVSSASTKGPSVFPLAPSSKSTSGGTAAL<br>GCLVKDYFPEPVTVSWNSGALTSGVHTFPAVLQSSGLYSLSSVVTVPSSSLGTQTYICNVNHKPSNTKVDKRVEPKS<br>CDKTHTCPPCPAPEAAGGPSVFLFPPKPKDTLMISRTPEVTCVVVDVSHEDPEVKFNWYVDGVEVHNAKTKPREE<br>QYNSTYRVVSVLTVLHQDWLNGKEYKCKVSNKALPAPIEKTISKAKGQPREPQVYTLPPSREEMTKNQVSLTCLVK<br>GFYPSDIAVEWESNGQPENNYKTTPPVLDSDGSFFLYSKLTVDKSRWQQGNVFSCSVMHEALHNHYTQKSLSLSP<br>GK |
| SEQ ID NO: 19 | DNA<br>Light Lambda | GATATCGAACTGACCCAGCCGCCTTCAGTGAGCGTTGCACCAGGTCAGACCGCGCGTATCTCGTGTAGCGGC<br>GATTCTCTTCGTAATAAGGTTTATTGGTACCAGCAGAAACCCGGGCAGGCGCCAGTTCTTGTGATTTATAAGA<br>ATAATCGTCCCTCAGGCATCCCGGAACGCTTTAGCGGATCCAACAGCGGCAACACCGCGACCCTGACCATTAG<br>CGGCACTCAGGCGGAAGACGAAGCGGATTATTATTGCCAGTCTTATGATGGTCAGAAGTCTCTTGTGTTTGGC<br>GGCGGCACGAAGTTAACCGTCCTAGGTCAGCCCAAGGCTGCCCCCTCGGTCACTCTGTTCCCGCCCTCCTCTG<br>AGGAGCTTCAAGCCAACAAGGCCACACTGGTGTGTCTCATAAGTGACTTCTACCCGGGAGCCGTGACAGTGG<br>CCTGGAAGGCAGATAGCAGCCCCGTCAAGGCGGGAGTGGAGACCACCACACCCTCCAAACAAAGCAACAAC<br>AAGTACGCGGCCAGCAGCTATCTGAGCCTGACGCCTGAGCAGTGGAAGTCCCACAGAAGCTACAGCTGCCAG<br>GTCACGCATGAAGGGAGCACCGTGGAGAAGACAGTGGCCCCTACAGAATGTTCA |
| SEQ ID NO: 20 | DNA<br>Heavy IgG1<br>LALA | CAGGTGCAATTGGTGGAAAGCGGCGGCGGCCTGGTGCAACCGGGCGGCAGCCTGCGTCTGAGCTGCGCGGC<br>CTCCGGATTTACCTTTTCTGATTATGTTATTAATTGGGTGCGCCAAGCCCCTGGGAAGGGTCTCGAGTGGGTG<br>AGCGGTATTTCTTGGTCTGGTGTTAATACTCATTATGCTGATTCTGTTAAGGGTCGTTTTACCATTTCACGTGAT<br>AATTCGAAAAACACCCTGTATCTGCAAATGAACAGCCTGCGTGCGGAAGATACGGCCGTGTATTATTGCGCGC<br>GTCTTGGTGCTACTGCTAATAATATTCGTTATAAGTTTATGGATGTTTGGGGCCAAGGCACCCTGGTGACGGT<br>TAGCTCAGCCTCCACCAAGGGTCCATCGGTCTTCCCCCTGGCACCCTCCTCCAAGAGCACCTCTGGGGGCACA<br>GCGGCCCTGGGCTGCCTGGTCAAGGACTACTTCCCCGAACCGGTGACGGTGTCGTGGAACTCAGGCGCCCTG<br>ACCAGCGGCGTGCACACCTTCCCGGCTGTCCTACAGTCCTCAGGACTCTACTCCCTCAGCAGCGTGGTGACCG<br>TGCCCTCCAGCAGCTTGGGCACCCAGACCTACATCTGCAACGTGAATCACAAGCCCAGCAACACCAAGGTGG<br>ACAAGAGAGTTGAGCCCAAATCTTGTGACAAAACTCACACATGCCCACCGTGCCCAGCACCTGAAGCAGCGG<br>GGGGACCGTCAGTCTTCCTCTTCCCCCCAAAACCCAAGGACACCCTCATGATCTCCCGGACCCCTGAGGTCAC<br>ATGCGTGGTGGTGGACGTGAGCCACGAAGACCCTGAGGTCAAGTTCAACTGGTACGTGGACGGCGTGGAGG |

TABLE 1-continued

| Examples of LRP6 Antibodies of the Present Invention | | |
|---|---|---|
| SEQ ID NUMBER | Ab region | Sequence |
| | | TGCATAATGCCAAGACAAAGCCGCGGGAGGAGCAGTACAACAGCACGTACCGGGTGGTCAGCGTCCTCACC GTCCTGCACCAGGACTGGCTGAATGGCAAGGAGTACAAGTGCAAGGTCTCCAACAAAGCCCTCCCAGCCCCC ATCGAGAAAACCATCTCCAAAGCCAAAGGGCAGCCCCGAGAACCACAGGTGTACACCCTGCCCCCATCCCGG GAGGAGATGACCAAGAACCAGGTCAGCCTGACCTGCCTGGTCAAAGGCTTCTATCCCAGCGACATCGCCGTG GAGTGGGAGAGCAATGGGCAGCCGGAGAACAACTACAAGACCACGCCTCCCGTGCTGGACTCCGACGGCTC CTTCTTCCTCTACAGCAAGCTCACCGTGGACAAGAGCAGGTGGCAGCAGGGGAACGTCTTCTCATGCTCCGTG ATGCATGAGGCTCTGCACAACCACTACACGCAGAAGAGCCTCTCCCTGTCTCCGGGTAAA |
| MOR08545 Prop1 | | |
| SEQ ID NO: 21 (Kabat) | HCDR1 | VNGMH |
| SEQ ID NO: 22 (Kabat) | HCDR2 | VIDGMGHTYYADSVKG |
| SEQ ID NO: 23 (Kabat) | HCDR3 | YDYIKYGAFDP |
| SEQ ID NO: 24 (Kabat) | LCDR1 | SGDNIGSKYVH |
| SEQ ID NO: 25 (Kabat) | LDCR2 | GDSNRPS |
| SEQ ID NO: 26 (Kabat) | LCDR3 | TRTSTPISGV |
| SEQ ID NO: 27 (Chothia) | HCDR1 | GFTFSVN |
| SEQ ID NO: 28 (Chothia) | HCDR2 | DGMGH |
| SEQ ID NO: 29 (Chothia) | HCDR3 | YDYIKYGAFDP |
| SEQ ID NO: 30 (Chothia) | LCDR1 | DNIGSKY |
| SEQ ID NO: 31 (Chothia) | LDCR2 | GDS |
| SEQ ID NO: 32 (Chothia) | LCDR3 | TSTPISG |

TABLE 1-continued

| Examples of LRP6 Antibodies of the Present Invention | | |
|---|---|---|
| SEQ ID NUMBER | Ab region | Sequence |
| SEQ ID NO: 33 | VL | DIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVL |
| SEQ ID NO: 34 | VH | QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSS |
| SEQ ID NO: 35 | VL Germlined | SYELTQPPSVSVSPGQTASITCSGDNIGSKYVHWYQQKPGQSPVLVIYGDSNRPSGIPERFSGSNSGNTATLTISGTQAMDEADYYCTRTSTPISGVFGGGTKLTVL |
| SEQ ID NO: 36 | VH Germlined | EVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSS |
| SEQ ID NO: 37 | DNA VL | GATATCGAACTGACCCAGCCGCCTTCAGTGAGCGTTGCACCAGGTCAGACCGCGCGTATCTCGTGTAGCGGCGATAATATTGGTTCTAAGTATGTTCATTGGTACCAGCAGAAACCCGGGCAGGCGCCAGTTCTTGTGATTTATGGTGATTCTAATCGTCCCTCAGGCATCCCGGAACGCTTTAGCGGATCCAACAGCGGCAACACCGCGACCCTGACCATTAGCGGCACTCAGGCGGAAGACGAAGCGGATTATTATTGCACTCGTACTTCTACTCCTATTTCTGGTGTGTTTGGCGGCGGCACGAAGTTAACCGTTCTT |
| SEQ ID NO: 38 | DNA VH | CAGGTGCAATTGGTGGAAAGCGGCGGCGGCCTGGTGCAACCGGGCGGCAGCCTGCGTCTGAGCTGCGCGGCCTCCGGATTTACCTTTTCTGTTAATGGTATGCATTGGGTGCGCCAAGCCCCTGGGAAGGGTCTCGAGTGGGTGAGCGTTATTGATGGTATGGGTCATACTTATTATGCTGATTCTGTTAAGGGTCGTTTTACCATTTCACGTGATAATTCGAAAAACACCCTGTATCTGCAAATGAACAGCCTGCGTGCGGAAGATACGGCCGTGTATTATTGCGCGCGTTATGATTATATTAAGTATGGTGCTTTTGATCCTTGGGGCCAAGGCACCCTGGTGACGGTTAGCTCA |
| SEQ ID NO: 39 | Light lambda | DIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEA |
| SEQ ID NO: 40 | Heavy Fab | QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS |
| SEQ ID NO: 41 | DNA Light lambda | GATATCGAACTGACCCAGCCGCCTTCAGTGAGCGTTGCACCAGGTCAGACCGCGCGTATCTCGTGTAGCGGCGATAATATTGGTTCTAAGTATGTTCATTGGTACCAGCAGAAACCCGGGCAGGCGCCAGTTCTTGTGATTTATGGTGATTCTAATCGTCCCTCAGGCATCCCGGAACGCTTTAGCGGATCCAACAGCGGCAACACCGCGACCCTGACCATTAGCGGCACTCAGGCGGAAGACGAAGCGGATTATTATTGCACTCGTACTTCTACTCCTATTTCTGGTGTGTTTGGCGGCGGCACGAAGTTAACCGTTCTTGGCCAGCCGAAAGCCGCACCGAGTGTGACGCTGTTTCCGCCGAGCAGCGAAGAATTGCAGGCGAACAAAGCGACCCTGGTGTGCCTGATTAGCGACTTTTATCCGGGAGCCGTGACAGTGGCCTGGAAGGCAGATAGCAGCCCCGTCAAGGCGGGAGTGGAGACCACCACACCCTCCAAACAAAGCAACAACAAGTACGCGGCCAGCAGCTATCTGAGCCTGACGCCTGAGCAGTGGAAGTCCCACAGAAGCTACAGCTGCCAGGTCACGCATGAGGGGAGCACCGTGGAAAAAACCGTTGCGCCGACTGAGGCC |
| SEQ ID NO: 42 | DNA Heavy Fab | CAGGTGCAATTGGTGGAAAGCGGCGGCGGCCTGGTGCAACCGGGCGGCAGCCTGCGTCTGAGCTGCGCGGCCTCCGGATTTACCTTTTCTGTTAATGGTATGCATTGGGTGCGCCAAGCCCCTGGGAAGGGTCTCGAGTGGGTGAGCGTTATTGATGGTATGGGTCATACTTATTATGCTGATTCTGTTAAGGGTCGTTTTACCATTTCACGTGATAATTCGAAAAACACCCTGTATCTGCAAATGAACAGCCTGCGTGCGGAAGATACGGCCGTGTATTATTGCGCGCGTTATGATTATATTAAGTATGGTGCTTTTGATCCTTGGGGCCAAGGCACCCTGGTGACGGTTAGCTCAGCGTCGA |

TABLE 1-continued

| Examples of LRP6 Antibodies of the Present Invention | | |
|---|---|---|
| SEQ ID NUMBER | Ab region | Sequence |
| | | CCAAAGGTCCAAGCGTGTTTCCGCTGGCTCCGAGCAGCAAAAGCACCAGCGGCGGCACGGCTGCCCTGGGCT GCCTGGTTAAAGATTATTTCCCGGAACCAGTCACCGTGAGCTGGAACAGCGGGGCGCTGACCAGCGGCGTGC ATACCTTTCCGGCGGTGCTGCAAAGCAGCGGCCTGTATAGCCTGAGCAGCGTTGTGACCGTGCCGAGCAGCA GCTTAGGCACTCAGACCTATATTTGCAACGTGAACCATAAACCGAGCAACACCAAAGTGGATAAAAAAGTGG AACCGAAAAGC |
| SEQ ID NO: 43 | VL Germlined | SYELTQPLSVSVALGQTARITCGGDNIGSKYVHWYQQKPGQAPVLVIYGDSNRPSGIPERFSGSNSGNTATLTISRA QAGDEADYYCTRTSTPISGVFGGGTKLTVL |
| SEQ ID NO: 44 | VH Germlined | EVQLLESGGGLVQPGGSLRLSCAASGFTFSVNGMHWVRQAPGKGLEWVSVIDGMGHTYYADSVKGRFTISRDN SKNTLYLQMNSLRAEDTAVYYCARYDYIKYGAFDPWGQGTLVTVSS |
| SEQ ID NO: 45 | DNA VL Germlined | AGCTATGAACTGACCCAGCCGCTGTCTGTGAGCGTGGCGCTGGGCCAGACCGCGCGTATTACCTGCGGTGGC GATAACATTGGCAGCAAATATGTGCATTGGTATCAGCAGAAACCGGGCCAGGCGCCGGTGCTGGTGATTTAT GGCGATAGCAACCGTCCGAGCGGCATTCCGGAACGTTTTAGCGGCAGCAACAGCGGCAACACCGCGACCCTG ACCATTTCTCGCGCGCAGGCGGGTGATGAAGCGGATTATTATTGCACCCGTACCAGCACCCCGATTAGCGGC GTGTTTGGCGGCGGTACGAAGTTAACCGTTCTT |
| SEQ ID NO: 46 | DNA VH Germlined | GAGGTGCAATTGCTGGAAAGCGGCGGCGGCCTGGTGCAACCGGGCGGCAGCCTGCGTCTGAGCTGCGCGGC CTCCGGATTTACCTTTTCTGTTAATGGTATGCATTGGGTGCGCCAAGCCCCTGGGAAGGGTCTCGAGTGGGTG AGCGTTATTGATGGTATGGGTCATACTTATTATGCTGATTCTGTTAAGGGTCGTTTTACCATTTCACGTGATAA TTCGAAAAACACCCTGTATCTGCAAATGAACAGCCTGCGTGCGGAAGATACGGCCGTGTATTATTGCGCGCGT TATGATTATATTAAGTATGGTGCTTTTGATCCTTGGGGCCAAGGCACCCTGGTGACGGTTAGCTCA |
| MOR06706 Prop1 | | |
| SEQ ID NO: 47 (Kabat) | HCDR1 | DYAIH |
| SEQ ID NO: 48 (Kabat) | HCDR2 | GISYSGSSTHYADSVKG |
| SEQ ID NO: 49 (Kabat) | HCDR3 | GSHGNIMAKRYFDF |
| SEQ ID NO: 50 (Kabat) | LCDR1 | SGDNIRKKYVY |
| SEQ ID NO: 51 (Kabat) | LDCR2 | EDSKRPS |
| SEQ ID NO: 52 (Kabat) | LCDR3 | STADSGINNGV |
| SEQ ID NO: 53 (Chothia) | HCDR1 | GFTFSDY |

TABLE 1-continued

| SEQ ID NUMBER | Ab region | Sequence |
|---|---|---|
| | Examples of LRP6 Antibodies of the Present Invention | |
| SEQ ID NO: 54 (Chothia) | HCDR2 | SYSGSS |
| SEQ ID NO: 55 (Chothia) | HCDR3 | GSHGNIMAKRYFDF |
| SEQ ID NO: 56 (Chothia) | LCDR1 | DNIRKKY |
| SEQ ID NO: 57 (Chothia) | LDCR2 | EDS |
| SEQ ID NO: 58 (Chothia) | LCDR3 | ADSGINNG |
| SEQ ID NO: 59 | VL | DIELTQPPSVSVAPGQTARISCSGDNIRKKYVYWYQQKPGQAPVLVIYEDSKRPSGIPERFSGSNSGNTATLTISGTQ AEDEADYYCSTADSGINNGVFGGGTKLTVL |
| SEQ ID NO: 60 | VH | QVQLVESGGGLVQPGGSLRLSCAASGFTFSDYAIHWVRQAPGKGLEWVSGISYSGSSTHYADSVKGRFTISRDNSK NTLYLQMNSLRAEDTAVYYCARGSHGNIMAKRYFDFWGQGTLVTVSS |
| SEQ ID NO: 61 | VL Germlined | SYELTQPPSVSVSPGQTASITCSGDNIRKKYVYWYQQKPGQSPVLVIYEDSKRPSGIPERFSGSNSGNTATLTISGTQ AMDEADYYCSTADSGINNGVFGGGTKLTVL |
| SEQ ID NO: 62 | VH Germlined | EVQLVESGGGLVQPGGSLRLSCAASGFTFSDYAIHWVRQAPGKGLEWVSGISYSGSSTHYADSVKGRFTISRDNSK NTLYLQMNSLRAEDTAVYYCARGSHGNIMAKRYFDFWGQGTLVTVSS |
| SEQ ID NO: 63 | DNA VL | GATATCGAACTGACCCAGCCGCCTTCAGTGAGCGTTGCACCAGGTCAGACCGCGCGTATCTCGTGTAGCGGC GATAATATTCGTAAGAAGTATGTTTATTGGTACCAGCAGAAACCCGGGCAGGCGCCAGTTCTTGTGATTTATG AGGATTCTAAGCGTCCCTCAGGCATCCCGGAACGCTTTAGCGGATCCAACAGCGGCAACACCGCGACCCTGA CCATTAGCGGCACTCAGGCGGAAGACGAAGCGGATTATTATTGCTCTACTGCTGATTCTGGTATTAATAATGG TGTGTTTGGCGGCGGCACGAAGTTAACCGTTCTT |
| SEQ ID NO: 64 | DNA VH | CAGGTGCAATTGGTGGAAAGCGGCGGCGGCCTGGTGCAACCGGGCGGCAGCCTGCGTCTGAGCTGCGCGGC CTCCGGATTTACCTTTTCTGATTATGCTATTCATTGGGTGCGCCAAGCCCCTGGGAAGGGTCTCGAGTGGGTG AGCGGTATCTCTTATTCTGGTAGCTCTACCCATTATGCGGATAGCGTGAAAGGCCGTTTTACCATTTCACGTGA TAATTCGAAAAACACCCTGTATCTGCAAATGAACAGCCTGCGTGCGGAAGATACGGCCGTGTATTATTGCGCG CGTGGTTCTCATGGTAATATTATGGCTAAGCGTTATTTTGATTTTTGGGGCCAAGGCACCCTGGTGACGGTTA GCTCA |
| SEQ ID NO: 65 | Light Lambda | DIELTQPPSVSVAPGQTARISCSGDNIRKKYVYWYQQKPGQAPVLVIYEDSKRPSGIPERFSGSNSGNTATLTISGTQ AEDEADYYCSTADSGINNGVFGGGTKLTVLGQPKAAPSVTLFPPSSEELQANKATLVCLISDFYPGAVTVAWKADS SPVKAGVETTTPSKQSNNKYAASSYLSLTPEQWKSHRSYSCQVTHEGSTVEKTVAPTECS |
| SEQ ID NO: 66 | Heavy IgG1 LALA | QVQLVESGGGLVQPGGSLRLSCAASGFTFSDYAIHWVRQAPGKGLEWVSGISYSGSSTHYADSVKGRFTISRDNSK NTLYLQMNSLRAEDTAVYYCARGSHGNIMAKRYFDFWGQGTLVTVSSASTKGPSVFPLAPSSKSTSGGTAALGCL |

TABLE 1-continued

Examples of LRP6 Antibodies of the Present Invention

| SEQ ID NUMBER | Ab region | Sequence |
| --- | --- | --- |
| | | VKDYFPEPVTVSWNSGALTSGVHTFPAVLQSSGLYSLSSVVTVPSSSLGTQTYICNVNHKPSNTKVDKRVEPKSCDK<br>THTCPPCPAPEAAGGPSVFLFPPKPKDTLMISRTPEVTCVVVDVSHEDPEVKFNWYVDGVEVHNAKTKPREEQYN<br>STYRVVSVLTVLHQDWLNGKEYKCKVSNKALPAPIEKTISKAKGQPREPQVYTLPPSREEMTKNQVSLTCLVKGFYP<br>SDIAVEWESNGQPENNYKTTPPVLDSDGSFFLYSKLTVDKSRWQQGNVFSCSVMHEALHNHYTQKSLSLSPGK |
| SEQ ID NO: 67 | DNA hlamda | GATATCGAACTGACCCAGCCGCCTTCAGTGAGCGTTGCACCAGGTCAGACCGCGCGTATCTCGTGTAGCGGC<br>GATAATATTCGTAAGAAGTATGTTTATTGGTACCAGCAGAAACCCGGGCAGGCGCCAGTTCTTGTGATTTATG<br>AGGATTCTAAGCGTCCCTCAGGCATCCCGGAACGCTTTAGCGGATCCAACAGCGGCAACACCGCGACCCTGA<br>CCATTAGCGGCACTCAGGCGGAAGACGAAGCGGATTATTATTGCTCTACTGCTGATTCTGGTATTAATAATGG<br>TGTGTTTGGCGGCGGCACGAAGTTAACCGTCCTAGGTCAGCCCAAGGCTGCCCCCTCGGTCACTCTGTTCCCG<br>CCCTCCTCTGAGGAGCTTCAAGCCAACAAGGCCACACTGGTGTGTCTCATAAGTGACTTCTACCCGGGAGCCG<br>TGACAGTGGCCTGGAAGGCAGATAGCAGCCCCGTCAAGGCGGGAGTGGAGACCACCACACCCTCCAAACAA<br>AGCAACAACAAGTACGCGGCCAGCAGCTATCTGAGCCTGACGCCTGAGCAGTGGAAGTCCCACAGAAGCTAC<br>AGCTGCCAGGTCACGCATGAAGGGAGCACCGTGGAGAAGACAGTGGCCCCTACAGAATGTTCA |
| SEQ ID NO: 68 | DNA Heavy IgG1 LALA | CAGGTGCAATTGGTGGAAAGCGGCGGCGGCCTGGTGCAACCGGGCGGCAGCCTGCGTCTGAGCTGCGCGGC<br>CTCCGGATTTACCTTTTCTGATTATGCTATTCATTGGGTGCGCCAAGCCCCTGGGAAGGGTCTCGAGTGGGTG<br>AGCGGTATCTCTTATTCTGGTAGCTCTACCCATTATGCGGATAGCGTGAAAGGCCGTTTTACCATTTCACGTGA<br>TAATTCGAAAAACACCCTGTATCTGCAAATGAACAGCCTGCGTGCGGAAGATACGGCCGTGTATTATTGCGCG<br>CGTGGTTCTCATGGTAATATTATGGCCAAGCGTTATTTTGATTTTTGGGGCCAAGGCACCCTGGTGACGGTTA<br>GCTCAGCCTCCACCAAGGGTCCATCGGTCTTCCCCCTGGCACCCTCCTCCAAGAGCACCTCTGGGGGCACAGC<br>GGCCCTGGGCTGCCTGGTCAAGGACTACTTCCCCGAACCGGTGACGGTGTCGTGGAACTCAGGCGCCCTGAC<br>CAGCGGCGTGCACACCTTCCCGGCTGTCCTACAGTCCTCAGGACTCTACTCCCTCAGCAGCGTGGTGACCGTG<br>CCCTCCAGCAGCTTGGGCACCCAGACCTACATCTGCAACGTGAATCACAAGCCCAGCAACACCAAGGTGGAC<br>AAGAGAGTTGAGCCCAAATCTTGTGACAAAACTCACACATGCCCACCGTGCCCAGCACCTGAAGCAGCGGGG<br>GGACCGTCAGTCTTCCTCTTCCCCCCAAAACCCAAGGACACCCTCATGATCTCCCGGACCCCTGAGGTCACATG<br>CGTGGTGGTGGACGTGAGCCACGAAGACCCTGAGGTCAAGTTCAACTGGTACGTGGACGGCGTGGAGGTGC<br>ATAATGCCAAGACAAAGCCGCGGGAGGAGCAGTACAACAGCACGTACCGGGTGGTCAGCGTCCTCACCGTCC<br>TGCACCAGGACTGGCTGAATGGCAAGGAGTACAAGTGCAAGGTCTCCAACAAAGCCCTCCCAGCCCCCATCG<br>AGAAAACCATCTCCAAAGCCAAAGGGCAGCCCCGAGAACCACAGGTGTACACCCTGCCCCCATCCCGGGAGG<br>AGATGACCAAGAACCAGGTCAGCCTGACCTGCCTGGTCAAAGGCTTCTATCCCAGCGACATCGCCGTGGAGT<br>GGGAGAGCAATGGGCAGCCGGAGAACAACTACAAGACCACGCCTCCCGTGCTGGACTCCGACGGCTCCTTCT<br>TCCTCTACAGCAAGCTCACCGTGGACAAGAGCAGGTGGCAGCAGGGGAACGTCTTCTCATGCTCCGTGATGC<br>ATGAGGCTCTGCACAACCACTACACGCAGAAGAGCCTCTCCCTGTCTCCGGGTAAA |
| MOR06475 Prop3 | | |
| SEQ ID NO: 69 (Kabat) | HCDR1 | NRGGGVG |
| SEQ ID NO: 70 (Kabat) | HCDR2 | WIDWDDDKSYSTSLKT |
| SEQ ID NO: 71 (Kabat) | HCDR3 | MHLPLVFDS |

TABLE 1-continued

| Examples of LRP6 Antibodies of the Present Invention | | |
|---|---|---|
| SEQ ID NUMBER | Ab region | Sequence |
| SEQ ID NO: 72 (Kabat) | LCDR1 | RASQFIGSRYLA |
| SEQ ID NO: 73 (Kabat) | LDCR2 | GASNRAT |
| SEQ ID NO: 74 (Kabat) | LCDR3 | QQYYDYPQT |
| SEQ ID NO: 75 (Chothia) | HCDR1 | GFSLSNRGG |
| SEQ ID NO: 76 (Chothia) | HCDR2 | DWDDD |
| SEQ ID NO: 77 (Chothia) | HCDR3 | MHLPLVFDS |
| SEQ ID NO: 78 (Chothia) | LCDR1 | SQFIGSRY |
| SEQ ID NO: 79 (Chothia) | LDCR2 | GAS |
| SEQ ID NO: 80 (Chothia) | LCDR3 | YYDYPQ |
| SEQ ID NO: 81 | VL | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIK |
| SEQ ID NO: 82 | VH | QVQLKESGPALVKPTQTLTLTCTFSGFSLSNRGGGVGWIRQPPGKALEWLAWIDWDDDKSYSTSLKTRLTISKDTS KNQVVLTMTNMDPVDTATYYCARMHLPLVFDSWGQGTLVTVSS |
| SEQ ID NO: 83 | DNA VL | GATATCGTGCTGACCCAGAGCCCGGCGACCCTGAGCCTGTCTCCGGGCGAACGTGCGACCCTGAGCTGCAGA GCGAGCCAGTTTATTGGTTCTCGTTATCTGGCTTGGTACCAGCAGAAACCAGGTCAAGCACCGCGTCTATTAA TTTATGGTGCTTCTAATCGTGCAACTGGGGTCCCGGCGCGTTTTAGCGGCTCTGGATCCGGCACGGATTTTAC CCTGACCATTAGCAGCCTGGAACCTGAAGACTTTGCGACTTATTATTGCCAGCAGTATTATGATTATCCTCAGA CCTTTGGCCAGGGTACGAAAGTTGAAATTAAA |
| SEQ ID NO: 84 | DNA VH | CAGGTGCAATTGAAAGAAAGCGGCCCGGCCCTGGTGAAACCGACCCAAACCCTGACCCTGACCTGTACCTTTT CCGGATTTAGCCTGTCTAATCGTGGTGGTGGTGTGGGTTGGATTCGCCAGCCGCCTGGGAAAGCCCTCGAGT GGCTGGCTTGGATCGATTGGGATGATGATAAGTCTTATAGCACCAGCCTGAAAACGCGTCTGACCATTAGCA AAGATACTTCGAAAAATCAGGTGGTGCTGACTATGACCAACATGGACCCGGTGGATACGGCCACCTATTATTG CGCGCGTATGCATCTTCCTCTTGTTTTTGATTCTTGGGGCCAAGGCACCCTGGTGACGGTTAGCTCA |

TABLE 1-continued

| Examples of LRP6 Antibodies of the Present Invention | | |
|---|---|---|
| SEQ ID NUMBER | Ab region | Sequence |
| SEQ ID NO: 85 | Light kappa | DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKRTVAAPSVFIFPPSDEQLKSGTASVVCLLNNFYPREAKVQWKVDNAL<br>QSGNSQESVTEQDSKDSTYSLSSTLTLSKADYEKHKVYACEVTHQGLSSPVTKSFNRGEC |
| SEQ ID NO: 86 | Heavy IgG1 LALA | QVQLKESGPALVKPTQTLTLTCTFSGFSLSNRGGGVGWIRQPPGKALEWLAWIDWDDDKSYSTSLKTRLTISKDTS<br>KNQVVLTMTNMDPVDTATYYCARMHLPLVFDSWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYICNVNHKPSNTKVDKRVEPKSCDKTHT<br>CPPCPAPEAAGGPSVFLFPPKPKDTLMISRTPEVTCVVVDVSHEDPEVKFNWYVDGVEVHNAKTKPREEQYNSTY<br>RVVSVLTVLHQDWLNGKEYKCKVSNKALPAPIEKTISKAKGQPREPQVYTLPPSREEMTKNQVSLTCLVKGFYPSDI<br>AVEWESNGQPENNYKTTPPVLDSDGSFFLYSKLTVDKSRWQQGNVFSCSVMHEALHNHYTQKSLSLSPGK |
| SEQ ID NO: 87 | DNA Light kappa | GATATCGTGCTGACCCAGAGCCCGGCGACCCTGAGCCTGTCTCCGGGCGAACGTGCGACCCTGAGCTGCAGA<br>GCGAGCCAGTTTATTGGTTCTCGTTATCTGGCTTGGTACCAGCAGAAACCAGGTCAAGCACCGCGTCTATTAA<br>TTTATGGTGCTTCTAATCGTGCAACTGGGGTCCCGGCGCGTTTTAGCGGCTCTGGATCCGGCACGGATTTTAC<br>CCTGACCATTAGCAGCCTGGAACCTGAAGACTTTGCGACTTATTATTGCCAGCAGTATTATGATTATCCTCAGA<br>CCTTTGGCCAGGGTACGAAAGTTGAAATTAAACGTACGGTGGCTGCACCATCTGTCTTCATCTTCCCGCCATCT<br>GATGAGCAGTTGAAATCTGGAACTGCCTCTGTTGTGTGCCTGCTGAATAACTTCTATCCCAGAGAGGCCAAAG<br>TACAGTGGAAGGTGGATAACGCCCTCCAATCGGGTAACTCCCAGGAGAGTGTCACAGAGCAGGACAGCAAG<br>GACAGCACCTACAGCCTCAGCAGCACCCTGACGCTGAGCAAAGCAGACTACGAGAAACACAAAGTCTACGCC<br>TGCGAAGTCACCCATCAGGGCCTGAGCTCGCCCGTCACAAAGAGCTTCAACAGGGGAGAGTGT |
| SEQ ID NO: 88 | DNA Heavy IgG1 LALA | CAGGTGCAATTGAAAGAAAGCGGCCCGGCCCTGGTGAAACCGACCCAAACCCTGACCCTGACCTGTACCTTTT<br>CCGGATTTAGCCTGTCTAATCGTGGTGGTGGTGTGGGTTGGATTCGCCAGCCGCCTGGGAAAGCCCTCGAGT<br>GGCTGGCTTGGATCGATTGGGATGATGATAAGTCTTATAGCACCAGCCTGAAAACGCGTCTGACCATTAGCA<br>AAGATACTTCGAAAAATCAGGTGGTGCTGACTATGACCAACATGGACCCGGTGGATACGGCCACCTATTATTG<br>CGCGCGTATGCATCTTCCTCTTGTTTTTGATTCTTGGGGCCAAGGCACCCTGGTGACGGTTAGCTCAGCCTCCA<br>CCAAGGGTCCATCGGTCTTCCCCCTGGCACCCTCCTCCAAGAGCACCTCTGGGGGCACAGCGGCCCTGGGCTG<br>CCTGGTCAAGGACTACTTCCCCGAACCGGTGACGGTGTCGTGGAACTCAGGCGCCCTGACCAGCGGCGTGCA<br>CACCTTCCCGGCTGTCCTACAGTCCTCAGGACTCTACTCCCTCAGCAGCGTGGTGACCGTGCCCTCCAGCAGCT<br>TGGGCACCCAGACCTACATCTGCAACGTGAATCACAAGCCCAGCAACACCAAGGTGGACAAGAGAGTTGAGC<br>CCAAATCTTGTGACAAAACTCACACATGCCCACCGTGCCCAGCACCTGAAGCAGCGGGGGGACCGTCAGTCTT<br>CCTCTTCCCCCCAAAACCCAAGGACACCCTCATGATCTCCCGGACCCCTGAGGTCACATGCGTGGTGGTGGAC<br>GTGAGCCACGAAGACCCTGAGGTCAAGTTCAACTGGTACGTGGACGGCGTGGAGGTGCATAATGCCAAGAC<br>AAAGCCGCGGGAGGAGCAGTACAACAGCACGTACCGGGTGGTCAGCGTCCTCACCGTCCTGCACCAGGACT<br>GGCTGAATGGCAAGGAGTACAAGTGCAAGGTCTCCAACAAAGCCCTCCCAGCCCCCATCGAGAAAACCATCT<br>CCAAAGCCAAAGGGCAGCCCCGAGAACCACAGGTGTACACCCTGCCCCCATCCCGGGAGGAGATGACCAAG<br>AACCAGGTCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCTCTACAGCA<br>AGCTCACCGTGGACAAGAGCAGGTGGCAGCAGGGGAACGTCTTCTCATGCTCCGTGATGCATGAGGCTCTGC<br>ACAACCACTACACGCAGAAGAGCCTCTCCCTGTCTCCGGGTAAA |
| SEQ ID NO: 89 | VH Germlined | QVTLKESGPALVKPTQTLTLTCTFSGFSLSNRGGGVGWIRQPPGKALEWLAWIDWDDDKSYSTSLKTRLTISKDTS<br>KNQVVLTMTNMDPVDTATYYCARMHLPLVFDSWGQGTLVTVSS |

TABLE 1-continued

Examples of LRP6 Antibodies of the Present Invention

| SEQ ID NUMBER | Ab region | Sequence |
|---|---|---|
| SEQ ID NO: 90 | VL Germlined | EIVLTQSPATLSLSPGERATLSCRASQFIGSRYLAWYQQKPGQAPRLLIYGASNRATGIPARFSGSGSGTDFTLTISSLE PEDFAVYYCQQYYDYPQTFGQGTKVEIK |
| SEQ ID NO: 91 | DNA VH Germlined | CAGGTCACACTGAAAGAGTCCGGCCCTGCCCTGGTCAAACCCACCCAGACCCTGACCCTGACATGCACCTTCA GCGGCTTCAGCCTGAGCAACAGAGGCGGCGGAGTGGGCTGGATCAGACAGCCTCCCGGCAAGGCCCTGGAA TGGCTGGCCTGGATCGACTGGGACGACGACAAGAGCTACAGCACCAGCCTGAAAACCCGGCTGACCATCAGC AAGGACACCAGCAAGAACCAGGTGGTGCTGACCATGACCAACATGGACCCCGTGGACACCGCCACCTACTAC TGCGCCCGGATGCATCTGCCCCTGGTGTTCGATAGCTGGGGCCAGGGCACCCTGGTCACCGTCAGCTCA |
| SEQ ID NO: 92 | DNA VL Germlined | GAAATCGTGCTGACCCAGAGCCCCGCCACCCTGTCTCTGAGCCCTGGCGAGAGAGCCACCCTGAGCTGCCGG GCCAGCCAGTTCATCGGCAGCAGATACCTGGCTTGGTATCAGCAGAAGCCCGGCCAGGCCCCCAGACTGCTG ATCTACGGCGCCAGCAACCGGGCCACCGGCATCCCTGCCAGATTTTCTGGCAGCGGCAGCGGCACCGACTTC ACCCTGACCATCAGCAGCCTGGAACCCGAGGACTTCGCCGTGTACTACTGCCAGCAGTACTACGACTACCCCC AGACCTTCGGCCAGGGCACCAAGGTGGAAATCAAG |
| MOR08193 Prop3 | | |
| SEQ ID NO: 93 (Kabat) | HCDR1 | NRGGGVG |
| SEQ ID NO: 94 (Kabat) | HCDR2 | WIDWDDDKSYSTSLKT |
| SEQ ID NO: 95 (Kabat) | HCDR3 | MHLPLVFDS |
| SEQ ID NO: 96 (Kabat) | LCDR1 | RASQFIGSRYLA |
| SEQ ID NO: 97 (Kabat) | LDCR2 | GASNRAT |
| SEQ ID NO: 98 (Kabat) | LCDR3 | QQYWSIPIT |
| SEQ ID NO: 99 (Chothia) | HCDR1 | GFSLSNRGG |
| SEQ ID NO: 100 (Chothia) | HCDR2 | DWDDD |
| SEQ ID NO: 101 (Chothia) | HCDR3 | MHLPLVFDS |

TABLE 1-continued

Examples of LRP6 Antibodies of the Present Invention

| SEQ ID NUMBER | Ab region | Sequence |
|---|---|---|
| SEQ ID NO: 102 (Chothia) | LCDR1 | SQFIGSRY |
| SEQ ID NO: 103 (Chothia) | LDCR2 | GAS |
| SEQ ID NO: 104 (Chothia) | LCDR3 | YWSIPI |
| SEQ ID NO: 105 | VL | DIVLTQSPATLSLSPGERATLSCRASQFIGSRYLAWYQQKPGQAPRLLIYGASNRATGVPARFSGSGSGTDFTLTISSL EPEDFAVYYCQQYWSIPITFGQGTKVEIK |
| SEQ ID NO: 106 | VH | QVQLKESGPALVKPTQTLTLTCTFSGFSLSNRGGGVGWIRQPPGKALEWLAWIDWDDDKSYSTSLKTRLTISKDTS KNQVVLTMTNMDPVDTATYYCARMHLPLVFDSWGQGTLVTVSS |
| SEQ ID NO: 107 | VL Germlined | EIVLTQSPATLSLSPGERATLSCRASQFIGSRYLAWYQQKPGQAPRLLIYGASNRATGIPARFSGSGSGTDFTLTISSLE PEDFAVYYCQQYWSIPITFGQGTKVEIK |
| SEQ ID NO: 108 | VH Germlined | QVTLKESGPALVKPTQTLTLTCTFSGFSLSNRGGGVGWIRQPPGKALEWLAWIDWDDDKSYSTSLKTRLTISKDTS KNQVVLTMTNMDPVDTATYYCARMHLPLVFDSWGQGTLVTVSS |
| SEQ ID NO: 109 | DNA VL | GATATCGTGCTGACCCAGAGCCCGGCGACCCTGAGCCTGTCTCCGGGCGAACGTGCGACCCTGAGCTGCAGA GCGAGCCAGTTTATTGGTTCTCGTTATCTGGCTTGGTACCAGCAGAAACCAGGTCAAGCACCGCGTCTATTAA TTTATGGTGCTTCTAATCGTGCAACTGGGGTCCCGGCGCGTTTTAGCGGCTCTGGATCCGGCACGGATTTTAC CCTGACCATTAGCAGCCTGGAACCTGAAGACTTTGCGGTGTATTATTGCCAGCAGTATTGGTCTATTCCTATTA CCTTTGGCCAGGGTACGAAAGTTGAAATTAAA |
| SEQ ID NO: 110 | DNA VH | CAGGTGCAATTGAAAGAAAGCGGCCCGGCCCTGGTGAAACCGACCCAAACCCTGACCCTGACCTGTACCTTTT CCGGATTTAGCCTGTCTAATCGTGGTGGTGGTGTGGGTTGGATTCGCCAGCCGCCTGGGAAAGCCCTCGAGT GGCTGGCTTGGATCGATTGGGATGATGATAAGTCTTATAGCACCAGCCTGAAAACGCGTCTGACCATTAGCA AAGATACTTCGAAAAATCAGGTGGTGCTGACTATGACCAACATGGACCCGGTGGATACGGCCACCTATTATTG CGCGCGTATGCATCTTCCTCTTGTTTTTGATTCTTGGGGCCAAGGCACCCTGGTGACGGTTAGCTCA |
| SEQ ID NO: 111 | Light kappa | DIVLTQSPATLSLSPGERATLSCRASQFIGSRYLAWYQQKPGQAPRLLIYGASNRATGVPARFSGSGSGTDFTLTISSL EPEDFAVYYCQQYWSIPITFGQGTKVEIKRTVAAPSVFIFPPSDEQLKSGTASVVCLLNNFYPREAKVQWKVDNAL QSGNSQESVTEQDSKDSTYSLSSTLTLSKADYEKHKVYACEVTHQGLSSPVTKSFNRGEA |
| SEQ ID NO: 112 | Heavy Fab | QVQLKESGPALVKPTQTLTLTCTFSGFSLSNRGGGVGWIRQPPGKALEWLAWIDWDDDKSYSTSLKTRLTISKDTS KNQVVLTMTNMDPVDTATYYCARMHLPLVFDSWGQGTLVTVSSASTKGPSVFPLAPSSKSTSGGTAALGCLVKD YFPEPVTVSWNSGALTSGVHTFPAVLQSSGLYSLSSVVTVPSSSLGTQTYICNVNHKPSNTKVDKKVEPKS |
| SEQ ID NO: 113 | DNA Light kappa | GATATCGTGCTGACCCAGAGCCCGGCGACCCTGAGCCTGTCTCCGGGCGAACGTGCGACCCTGAGCTGCAGA GCGAGCCAGTTTATTGGTTCTCGTTATCTGGCTTGGTACCAGCAGAAACCAGGTCAAGCACCGCGTCTATTAA TTTATGGTGCTTCTAATCGTGCAACTGGGGTCCCGGCGCGTTTTAGCGGCTCTGGATCCGGCACGGATTTTAC CCTGACCATTAGCAGCCTGGAACCTGAAGACTTTGCGGTGTATTATTGCCAGCAGTATTGGTCTATTCCTATTA CCTTTGGCCAGGGTACGAAAGTTGAAATTAAACGTACGGTGGCTGCTCCGAGCGTGTTTATTTTTCCGCCGAG CGATGAACAACTGAAAAGCGGCACGGCGAGCGTGGTGTGCCTGCTGAACAACTTTTATCCGCGTGAAGCGAA |

TABLE 1-continued

Examples of LRP6 Antibodies of the Present Invention

| SEQ ID NUMBER | Ab region | Sequence |
|---|---|---|
| | | AGTTCAGTGGAAAGTAGACAACGCGCTGCAAAGCGGCAACAGCCAGGAAAGCGTGACCGAACAGGATAGCAAAGATAGCACCTATTCTCTGAGCAGCACCCTGACCCTGAGCAAAGCGGATTATGAAAAACATAAAGTGTATGCGTGCGAAGTGACCCATCAAGGTCTGAGCAGCCCGGTGACTAAATCTTTTAATCGTGGCGAGGCC |
| SEQ ID NO: 114 | DNA Heavy Fab | CAGGTGCAATTGAAAGAAAGCGGCCCGGCCCTGGTGAAACCGACCCAAACCCTGACCCTGACCTGTACCTTTTCCGGATTTAGCCTGTCTAATCGTGGTGGTGGTGTGGGTTGGATTCGCCAGCCGCCTGGGAAAGCCCTCGAGTGGCTGGCTTGGATCGATTGGGATGATGATAAGTCTTATAGCACCAGCCTGAAAACGCGTCTGACCATTAGCAAAGATACTTCGAAAAATCAGGTGGTGCTGACTATGACCAACATGGACCCGGTGGATACGGCCACCTATTATTGCGCGCGTATGCATCTTCCTCTTGTTTTTGATTCTTGGGGCCAAGGCACCCTGGTGACGGTTAGCTCAGCGTCGACCAAAGGTCCAAGCGTGTTTCCGCTGGCTCCGAGCAGCAAAAGCACCAGCGGCGGCACGGCTGCCCTGGGCTGCCTGGTTAAAGATTATTTCCCGGAACCAGTCACCGTGAGCTGGAACAGCGGGGCGCTGACCAGCGGCGTGCATACCTTTCCGGCGGTGCTGCAAAGCAGCGGCCTGTATAGCCTGAGCAGCGTTGTGACCGTGCCGAGCAGCAGCTTAGGCACTCAGACCTATATTTGCAACGTGAACCATAAACCGAGCAACACCAAAGTGGATAAAAAAGTGGAACCGAAAAGC |
| MOR08473 Prop3 | | |
| SEQ ID NO: 115 (Kabat) | HCDR1 | SYGMS |
| SEQ ID NO: 116 (Kabat) | HCDR2 | NISNDGHYTYYADSVKG |
| SEQ ID NO: 117 (Kabat) | HCDR3 | FQASYLDIMDY |
| SEQ ID NO: 118 (Kabat) | LCDR1 | SGDNIGSKYVH |
| SEQ ID NO: 119 (Kabat) | LDCR2 | NDSNRPS |
| SEQ ID NO: 120 (Kabat) | LCDR3 | QAWGDNGTRV |
| SEQ ID NO: 121 (Chothia) | HCDR1 | GFTFSSY |
| SEQ ID NO: 122 (Chothia) | HCDR2 | SNDGHY |
| SEQ ID NO: 123 (Chothia) | HCDR3 | FQASYLDIMDY |
| SEQ ID NO: 124 (Chothia) | LCDR1 | DNIGSKY |

TABLE 1-continued

| Examples of LRP6 Antibodies of the Present Invention | | |
|---|---|---|
| SEQ ID NUMBER | Ab region | Sequence |
| SEQ ID NO: 125 (Chothia) | LDCR2 | NDS |
| SEQ ID NO: 126 (Chothia) | LCDR3 | WGDNGTR |
| SEQ ID NO: 127 | VL | DIELTQPPSVSVAPGQSITISCSGDNIGSKYVHWYQQKPGQAPVLVIYNDSNRPSGIPERFSGSNSGNTATLTISGTQ AEDEADYYCQAWGDNGTRVFGGGTKLTVL |
| SEQ ID NO: 128 | VH | QVQLVESGGGLVQPGGSLRLSCAASGFTFSSYGMSWVRQAPGKGLEWVSNISNDGHYTYYADSVKGRFTISRDN SKNTLYLQMNSLRAEDTAVYYCARFQASYLDIMDYWGQGTLVTVSS |
| SEQ ID NO: 129 | VL Germlined | SYELTQPPSVSVSPGQTASITCSGDNIGSKYVHWYQQKPGQSPVLVIYNDSNRPSGIPERFSGSNSGNTATLTISGT QAMDEADYYCQAWGDNGTRVFGGGTKLTVL |
| SEQ ID NO: 130 | VH Germlined | EVQLVESGGGLVQPGGSLRLSCAASGFTFSSYGMSWVRQAPGKGLEWVSNISNDGHYTYYADSVKGRFTISRDNS KNTLYLQMNSLRAEDTAVYYCARFQASYLDIMDYWGQGTLVTVSS |
| SEQ ID NO: 131 | DNA VL | GATATCGAACTGACCCAGCCGCCTTCAGTGAGCGTTGCACCAGGTCAGAGCATTACCATCTCGTGTAGCGGCG ATAATATTGGTTCTAAGTATGTTCATTGGTACCAGCAGAAACCCGGGCAGGCGCCAGTTCTTGTGATTTATAAT GATTCTAATCGTCCCTCAGGCATCCCGGAACGCTTTAGCGGATCCAACAGCGGCAACACCGCGACCCTGACCA TTAGCGGCACTCAGGCGGAAGACGAAGCGGATTATTATTGCCAGGCTTGGGGTGATAATGGTACTCGTGTGT TTGGCGGCGGCACGAAGTTAACCGTTCTT |
| SEQ ID NO: 132 | DNA VH | CAGGTGCAATTGGTGGAAAGCGGCGGCGGCCTGGTGCAACCGGGCGGCAGCCTGCGTCTGAGCTGCGCGGC CTCCGGATTTACCTTTTCTTCTTATGGTATGTCTTGGGTGCGCCAAGCCCCTGGGAAGGGTCTCGAGTGGGTG AGCAATATTTCTAATGATGGTCATTATACTTATTATGCTGATTCTGTTAAGGGTCGTTTTACCATTTCACGTGAT AATTCGAAAAACACCCTGTATCTGCAAATGAACAGCCTGCGTGCGGAAGATACGGCCGTGTATTATTGCGCGC GTTTTCAGGCTTCTTATCTTGATATTATGGATTATTGGGGCCAAGGCACCCTGGTGACGGTTAGCTCA |
| SEQ ID NO: 133 | Light lambda | DIELTQPPSVSVAPGQSITISCSGDNIGSKYVHWYQQKPGQAPVLVIYNDSNRPSGIPERFSGSNSGNTATLTISGTQ AEDEADYYCQAWGDNGTRVFGGGTKLTVLGQPKAAPSVTLFPPSSEELQANKATLVCLISDFYPGAVTVAWKADS SPVKAGVETTTPSKQSNNKYAASSYLSLTPEQWKSHRSYSCQVTHEGSTVEKTVAPTEA |
| SEQ ID NO: 134 | Heavy Fab | QVQLVESGGGLVQPGGSLRLSCAASGFTFSSYGMSWVRQAPGKGLEWVSNISNDGHYTYYADSVKGRFTISRDN SKNTLYLQMNSLRAEDTAVYYCARFQASYLDIMDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNTKVDKKVEPKS |
| SEQ ID NO: 135 | DNA Light lambda | GATATCGAACTGACCCAGCCGCCTTCAGTGAGCGTTGCACCAGGTCAGAGCATTACCATCTCGTGTAGCGGCG ATAATATTGGTTCTAAGTATGTTCATTGGTACCAGCAGAAACCCGGGCAGGCGCCAGTTCTTGTGATTTATAAT GATTCTAATCGTCCCTCAGGCATCCCGGAACGCTTTAGCGGATCCAACAGCGGCAACACCGCGACCCTGACCA TTAGCGGCACTCAGGCGGAAGACGAAGCGGATTATTATTGCCAGGCTTGGGGTGATAATGGTACTCGTGTGT TTGGCGGCGGCACGAAGTTAACCGTTCTTGGCCAGCCGAAAGCCGCACCGAGTGTGACGCTGTTTCCGCCGA GCAGCGAAGAATTGCAGGCGAACAAAGCGACCCTGGTGTGCCTGATTAGCGACTTTTATCCGGGAGCCGTGA CAGTGGCCTGGAAGGCAGATAGCAGCCCCGTCAAGGCGGGAGTGGAGACCACCACACCCTCCAAACAAAGC AACAACAAGTACGCGGCCAGCAGCTATCTGAGCCTGACGCCTGAGCAGTGGAAGTCCCACAGAAGCTACAGC TGCCAGGTCACGCATGAGGGGAGCACCGTGGAAAAAACCGTTGCGCCGACTGAGGCC |

TABLE 1-continued

Examples of LRP6 Antibodies of the Present Invention

| SEQ ID NUMBER | Ab region | Sequence |
|---|---|---|
| SEQ ID NO: 136 | DNA Heavy Fab | CAGGTGCAATTGGTGGAAAGCGGCGGCGGCCTGGTGCAACCGGGCGGCAGCCTGCGTCTGAGCTGCGCGGC<br>CTCCGGATTTACCTTTTCTTCTTATGGTATGTCTTGGGTGCGCCAAGCCCCTGGGAAGGGTCTCGAGTGGGTG<br>AGCAATATTTCTAATGATGGTCATTATACTTATTATGCTGATTCTGTTAAGGGTCGTTTTACCATTTCACGTGAT<br>AATTCGAAAAACACCCTGTATCTGCAAATGAACAGCCTGCGTGCGGAAGATACGGCCGTGTATTATTGCGCGC<br>GTTTTCAGGCTTCTTATCTTGATATTATGGATTATTGGGGCCAAGGCACCCTGGTGACGGTTAGCTCAGCGTC<br>GACCAAAGGTCCAAGCGTGTTTCCGCTGGCTCCGAGCAGCAAAAGCACCAGCGGCGGCACGGCTGCCCTGG<br>GCTGCCTGGTTAAAGATTATTTCCCGGAACCAGTCACCGTGAGCTGGAACAGCGGGGCGCTGACCAGCGGCG<br>TGCATACCTTTCCGGCGGTGCTGCAAAGCAGCGGCCTGTATAGCCTGAGCAGCGTTGTGACCGTGCCGAGCA<br>GCAGCTTAGGCACTCAGACCTATATTTGCAACGTGAACCATAAACCGAGCAACACCAAAGTGGATAAAAAAG<br>TGGAACCGAAAAGC |
| SEQ ID NO: 137 | VL Germlined | SYELTQPLSVSVALGQTARITCGGDNIGSKYVHWYQQKPGQAPVLVIYNDSNRPSGIPERFSGSNSGNTATLTISRA<br>QAGDEADYYCQAWGDNGTRVFGGGTKLTVL |
| SEQ ID NO: 138 | VH Germlined | EVQLLESGGGLVQPGGSLRLSCAASGFTFSSYGMSWVRQAPGKGLEWVSNISNDGHYTYYADSVKGRFTISRDNS<br>KNTLYLQMNSLRAEDTAVYYCARFQASYLDIMDYWGQGTLVTVSS |
| SEQ ID NO: 139 | DNA VL Germlined | AGCTATGAACTGACCCAGCCGCTGAGTGTTAGCGTTGCGCTGGGTCAGACCGCGCGTATTACCTGCGGCGGT<br>GATAACATTGGCAGCAAATATGTGCATTGGTATCAGCAGAAACCGGGCCAGGCGCCGGTGCTGGTGATTTAT<br>AACGATAGCAACCGTCCGAGCGGCATTCCGGAACGTTTTAGCGGCAGCAACAGCGGCAATACCGCGACCCTG<br>ACCATTAGCCGTGCGCAGGCGGGTGATGAAGCGGATTATTATTGCCAGGCGTGGGGCGATAATGGTACGCG<br>TGTGTTTGGCGGTGGTACGAAGTTAACCGTTCTT |
| SEQ ID NO: 140 | DNA VH Germlined | GAGGTGCAATTGCTGGAAAGCGGCGGCGGCCTGGTGCAACCGGGCGGCAGCCTGCGTCTGAGCTGCGCGGC<br>CTCCGGATTTACCTTTTCTTCTTATGGTATGTCTTGGGTGCGCCAAGCCCCTGGGAAGGGTCTCGAGTGGGTG<br>AGCAATATTTCTAATGATGGTCATTATACTTATTATGCTGATTCTGTTAAGGGTCGTTTTACCATTTCACGTGAT<br>AATTCGAAAAACACCCTGTATCTGCAAATGAACAGCCTGCGTGCGGAAGATACGGCCGTGTATTATTGCGCGC<br>GTTTTCAGGCTTCTTATCTTGATATTATGGATTATTGGGGCCAAGGCACCCTGGTGACGGTTAGCTCA |
| Biparatopic construction MOR06475 | | |
| SEQ ID NO: 141 | DNA VL-(GGGGS)3-VH scFv | Gatatcgttctgacccagagtccggcaaccctgagcctgagtccgggtgaacgtgccaccctgagctgtcgtgcaagccagtttattggtagccg<br>ttatctggcatggtatcagcagaaaccgggtcaggcaccgcgtctgctgatttatggtgcaagcaatcgtgcaaccggtgttccggcacgttttag<br>cggtagcggtagtggcaccgattttaccctgaccattagcagcctggaaccggaagattttgcaacctattattgccagcagtattatgattatcc<br>gcagacctttggtcagggcaccaaggtggaaattaaaggtggtggtggtagcggtggtggtggctcaggtggtggcggtagtcaggttcaattg<br>aaagaaagcggtccggcactggttaaaccgacccagaccctgaccctgacatgtacctttagcggttttagcctgagcaatcgtggtggtggtgt<br>tggttggattcgtcagcctccgggtaaagcactggaatggctggcatggattgattgggatgatgataaaagctatagcaccagcctgaaaacc<br>cgtctgaccattagtaaagataccagcaaaaatcaggtggttctgaccatgaccaatatggatccggttgataccgccacctattattgtgcacgt<br>atgcatctgccgctggtttttgatagctggggtcagggtacactagttaccgttagcagc |
| SEQ ID NO: 142 | VL-(GGGGS)3-VH scFv | DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKGGGGSGGGGSGGGGSQVQLKESGPALVKPTQTLTLTCTFSGFSLSN<br>RGGGVGWIRQPPGKALEWLAWIDWDDDKSYSTSLKTRLTISKDTSKNQVVLTMTNMDPVDTATYYCARMHLPL<br>VFDSWGQGTLVTVSS |

TABLE 1-continued

Examples of LRP6 Antibodies of the Present Invention

| SEQ ID NUMBER | Ab region | Sequence |
|---|---|---|
| SEQ ID NO: 143 | DNA VL-(GGGGS)4-VH scFv | Gatatcgtgctgacacagagccctgccaccctgtctctgagccctggcgagagagccaccctgagctgccgggccagccagttcatcggctccc gctacctggcctggtatcagcagaagcccggacaggctcccagactgctgatctacggcgccagcaacagagctaccggcgtgcccgccagatt ttctggcagcggcagcggcaccgacttcaccctgaccatcagcagcctggaacccgaggacttcgccacctactactgccagcagtactacgac taccccccagaccttcggccagggcaccaaggtggagatcaagggcggaggcggatccgggggtggcggaagtggaggcggaggaagcggag ggggcggaagccaggtgcaattgaaagagtccggccctgccctggtgaagcctacccagaccctgaccctgacatgcaccttcagcggcttcag cctgagcaacagaggcggcggagtgggctggatcagacagcctcccggcaaggccctggaatggctggcctggatcgactgggacgacgaca agagctacagcaccagcctgaaaacccggctgaccatctccaaggacaccagcaagaaccaggtggtgctcaccatgaccaacatggacccc gtggacaccgccacctattattgcgcccggatgcatctgcccctggtgttcgatagctggggccagggaaccctggtgacagtgtccagc |
| SEQ ID NO: 144 | VL-(GGGGS)4-VH scFv | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKGGGGSGGGGSGGGGSGGGGSQVQLKESGPALVKPTQTLTLTCTFS GFSLSNRGGGVGWIRQPPGKALEWLAWIDWDDDKSYSTSLKTRLTISKDTSKNQVVLTMTNMDPVDTATYYCAR MHLPLVFDSWGQGTLVTVSS |
| SEQ ID NO: 145 | DNA VH-(GGGGS)3-VL scFv | Caggttcaattgaaagaaagcggtccggcactggttaaaccgacccagaccctgaccctgacatgtacctttagcggttttagcctgagcaatc gtggtggtggtgttggttggattcgtcagcctccgggtaaagcactggaatggctggcatggattgattgggatgatgataaaagctatagcacc agcctgaaaacccgtctgaccattagcaaagataccagcaaaaatcaggttgttctgaccatgaccaatatggatccggttgataccgcaacct attattgtgcacgtatgcatctgccgctggtttttgatagctggggtcagggtacactagttaccgttagcagcggtggtggtggtagcggtggtg gcggttcaggtggtggtggcagtgatatcgttctgacccagagtccggcaaccctgagcctgagtccgggtgaacgtgccaccctgagctgtcgt gcaagccagtttattggtagccgttatctggcatggtatcagcagaaaccgggtcaggcaccgcgtctgctgatttatggtgcaagcaatcgtgc aaccggtgttccggcacgttttagcggtagcggtagtggcaccgatttaccctgaccattagtagcctggaaccggaagattttgccacctatta ttgccagcagtattatgattatccgcagacctttggtcagggcaccaaggtggaaattaaa |
| SEQ ID NO: 146 | VH-(GGGGS)3-VL scFv | QVQLKESGPALVKPTQTLTLTCTFSGFSLSNRGGGVGWIRQPPGKALEWLAWIDWDDDKSYSTSLKTRLTISKDTS KNQVVLTMTNMDPVDTATYYCARMHLPLVFDSWGQGTLVTVSSGGGGSGGGGSGGGGSDIVLTQSPATLSLSP GERATLSCRASQFIGSRYLAWYQQKPGQAPRLLIYGASNRATGVPARFSGSGSGTDFTLTISSLEPEDFATYYCQQY YDYPQTFGQGTKVEIK |
| SEQ ID NO: 147 | DNA VH-(GGGGS)4-VL scFv | Caggttcaattgaaagaaagcggtccggcactggttaaaccgacccagaccctgaccctgacatgtacctttagcggttttagcctgagcaatc gtggtggtggtgttggttggattcgtcagcctccgggtaaagcactggaatggctggcatggattgattgggatgatgataaaagctatagcacc agcctgaaaacccgtctgaccattagcaaagataccagcaaaaatcaggttgttctgaccatgaccaatatggatccggttgataccgcaacct attattgtgcacgtatgcatctgccgctggtttttgatagctggggtcagggtacactagttaccgttagcagcggtggtggtggtagcggtggtg gcggttcaggtggtggtggcagtggcggtggtggtagtgatatcgttctgacccagagtccggcaaccctgagcctgagtccgggtgaacgtgcc accctgagctgtcgtgcaagccagtttattggtagccgttatctggcatggtatcagcagaaaccgggtcaggcaccgcgtctgctgatttatggt gcaagcaatcgtgcaaccggtgttccggcacgttttagcggtagcggtagtggcaccgatttaccctgaccattagtagcctggaaccggaaga ttttgccacctattattgccagcagtattatgattatccgcagacctttggtcagggcaccaaggtggaaattaaa |
| SEQ ID NO: 148 | VH-(GGGGS)4-VL scFv | QVQLKESGPALVKPTQTLTLTCTFSGFSLSNRGGGVGWIRQPPGKALEWLAWIDWDDDKSYSTSLKTRLTISKDTS KNQVVLTMTNMDPVDTATYYCARMHLPLVFDSWGQGTLVTVSSGGGGSGGGGSGGGGSGGGGSDIVLTQSPA TLSLSPGERATLSCRASQFIGSRYLAWYQQKPGQAPRLLIYGASNRATGVPARFSGSGSGTDFTLTISSLEPEDFATYY CQQYYDYPQTFGQGTKVEIK |
| MOR08168 | | |
| SEQ ID NO: 149 | DNA VL-(GGGGS)3-VH scFv | Gatatcgaactgacccagcctccgagcgttagcgttgcaccgggtcagaccgcacgtattagctgtagcggtgatagcctgcgtaataaagttta ttggtatcagcagaaaccgggtcaggcaccggttctggttatttataaaaataatcgtccgagcggtattccggaacgttttagcggtagcaata gcggtaataccgcaaccctgaccattagcggcacccaggcagaagatgaagcagattattattgccagagctatgatggtcagaaaagcctgg tttttggtggtggcaccaagcttaccgttctgggtggtggtggtagcggtggtggtggctcaggtggtggcggttctcaggttcaattggttgaaag |

TABLE 1-continued

| Examples of LRP6 Antibodies of the Present Invention | | |
|---|---|---|
| SEQ ID NUMBER | Ab region | Sequence |
| | | tggtggtggtctggttcagcctggtggtagcctgcgtctgagctgtgcagcaagcggttttacctttagcgattatgtgattaattgggttcgccag gcaccgggtaaaggtctggaatgggttagcggtattagctggtcaggtgttaatacccattatgcagatagcgtgaaaggtcgttttaccattag ccgtgataatagcaaaaataccctgtatctgcagatgaatagcctgcgtgcagaagataccgcagtttattattgtgcacgtctgggtgcaaccg caaataatattcgctataaatttatggatgtgtggggtcagggtacactagttaccgttagcagc |
| SEQ ID NO: 150 | VL-(GGGGS)3-VH scFv | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGGGGSGGGGSGGGGSQVQLVESGGGLVQPGGSLRLSCAASGFTFSD YVINWVRQAPGKGLEWVSGISWSGVNTHYADSVKGRFTISRDNSKNTLYLQMNSLRAEDTAVYYCARLGATANN IRYKFMDVWGQGTLVTVSS |
| SEQ ID NO: 151 | DNA VL-(GGGGS)4-VH scFv | Gatatcgaactgacccagcctccgagcgttagcgttgcaccgggtcagaccgcacgtattagctgtagcggtgatagcctgcgtaataaagttta ttggtatcagcagaaaccgggtcaggcaccggttctggttatttataaaaataatcgtccgagcggtattccggaacgttttagcggtagcaata gcggtaataccgcaaccctgaccattagcggcacccaggcagaagatgaagcagattattattgccagagctatgatggtcagaaaagcctgg tttttggtggtggcaccaagcttaccgttctgggtggtggtggtagcggtggtggtggctcaggtggtggcggttctggtggcggtggttcacaggt tcaattggttgaaagtggtggtggtctggttcagcctggtggtagcctgcgtctgagctgtgcagcaagcggttttacctttagcgattatgtgatt aattgggttcgccaggcaccgggtaaaggtctggaatgggttagcggtattagctggtcaggtgttaatacccattatgcagatagcgtgaaag gtcgttttaccattagccgtgataatagcaaaaataccctgtatctgcagatgaatagcctgcgtgcagaagataccgcagtttattattgtgcac gtctgggtgcaaccgcaaataatattcgctataaatttatggatgtgtggggtcagggtacactagttaccgttagcagc |
| SEQ ID NO: 152 | VL-(GGGGS)4-VH scFv | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGGGGSGGGGSGGGGSGGGGSQVQLVESGGGLVQPGGSLRLSCAAS GFTFSDYVINWVRQAPGKGLEWVSGISWSGVNTHYADSVKGRFTISRDNSKNTLYLQMNSLRAEDTAVYYCARL GATANNIRYKFMDVWGQGTLVTVSS |
| SEQ ID NO: 153 | DNA VH-(GGGGS)3-VL scFv | Caggttcaattggttgaaagcggtggtggtctggttcagcctggtggtagcctgcgtctgagctgtgcagcaagcggttttacctttagcgattat gtgattaattgggttcgtcaggcaccgggtaaaggtctggaatgggttagcggtattagctggtcaggtgttaatacccattatgcagatagcgtg aaaggtcgttttaccattagccgtgataatagcaaaaataccctgtatctgcagatgaatagcctgcgtgcagaagataccgcagtttattattgt gcacgtctgggtgcaaccgcaaataatattcgctataaatttatggatgtgtggggtcagggtacactagttaccgttagcagtggtggtggtggt agcggtggtggcggatctggtggcggtggcagtgatatcgaactgacccagcctccgagcgttagcgttgcaccgggtcagaccgcacgtatta gctgtagcggtgatagtctgcgtaataaagtttattggtatcagcagaaaccgggtcaggctccggttctggttatttataaaaataatcgtccga gcggtattccggaacgttttagcggtagcaatagcggtaataccgcaaccctgaccattagcggcacccaggcagaagatgaagccgattatta ttgtcagagctatgatggtcagaaaagcctggtttttggtggtggcaccaagcttaccgttctg |
| SEQ ID NO: 154 | VH-(GGGGS)3-VL scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSGGGGSGGGGSGGGGSDIELTQPPS VSVAPGQTARISCSGDSLRNKVYWYQQKPGQAPVLVIYKNNRPSGIPERFSGSNSGNTATLTISGTQAEDEADYYC QSYDGQKSLVFGGGTKLTVL |
| SEQ ID NO: 155 | DNA VH-(GGGGS)4-VL scFv | Caggttcaattggttgaaagcggtggtggtctggttcagcctggtggtagcctgcgtctgagctgtgcagcaagcggttttacctttagcgattat gtgattaattgggttcgtcaggcaccgggtaaaggtctggaatgggttagcggtattagctggtcaggtgttaatacccattatgcagatagcgtg aaaggtcgttttaccattagccgtgataatagcaaaaataccctgtatctgcagatgaatagcctgcgtgcagaagataccgcagtttattattgt gcacgtctgggtgcaaccgcaaataatattcgctataaatttatggatgtgtggggtcagggtacactagttaccgttagcagtggtggtggtggt agcggtggtggcggatctggtggcggtggttcaggtggtggtggcagtgatatcgaactgacccagcctccgagcgttagcgttgcaccgggtc agaccgcacgtattagctgtagcggtgatagtctgcgtaataaagtttattggtatcagcagaaaccgggtcaggctccggttctggttatttata aaaataatcgtccgagcggtattccggaacgttttagcggtagcaatagcggtaataccgcaaccctgaccattagcggcacccaggcagaag atgaagccgattattattgtcagagctatgatggtcagaaaagcctggtttttggtggtggcaccaagcttaccgttctg |

TABLE 1-continued

| Examples of LRP6 Antibodies of the Present Invention | | |
|---|---|---|
| SEQ ID NUMBER | Ab region | Sequence |
| SEQ ID NO: 156 | VH-(GGGGS)4-VL scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSGGGGSGGGGSGGGGSGGGGSDIE LTQPPSVSVAPGQTARISCSGDSLRNKVYWYQQKPGQAPVLVIYKNNRPSGIPERFSGSNSGNTATLTTISGTQAED EADYYCQSYDGQKSLVFGGGTKLTVL |
| MOR08545 | | |
| SEQ ID NO: 157 | DNA VL-(GGGGS)3-VH scFv | Gatatcgaactgacccagcctccgagcgttagcgttgcaccgggtcagaccgcacgtattagctgtagcggtgataatattggcagcaaatatg tgcattggtatcagcagaaaccgggtcaggcaccggttctggttatttatggtgatagcaatcgtccgagcggtattccggaacgttttagcggta gcaatagcggtaataccgcaaccctgaccattagcggcacccaggcagaagatgaagcagattattattgtacccgtaccagcaccccgattag cggtgtttttggtggtggcaccaagcttaccgttctgggtggtggtggtagcggtggtggtggctcaggtggtggtggttcacaggttcaattggtt gaaagtggtggtggtctggttcagcctggtggtagcctgcgtctgagctgtgcagcaagcggttttacctttagcgttaatggtatgcattgggttc gccaggcaccgggtaaaggtctggaatgggttagcgttattgatggtatgggccatacctattatgccgatagcgttaaaggtcgttttaccatta gccgtgataatagcaaaaataccctgtatctgcagatgaatagcctgcgtgcagaagataccgcagtttattattgcgcacgctatgattatatta aatatggtgcctttgatccgtggggtcagggtacactagttaccgttagcagc |
| SEQ ID NO: 158 | VL-(GGGGS)3-VH scFv | DIELTQPPSVSVAPGQTARISCSGDNIGSKYVHWYQQKPGQAPVLVIYGDSNRPSGIPERFSGSNSGNTATLTISGT QAEDEADYYCTRTSTPISGVFGGGTKLTVLGGGGSGGGGSGGGGSQVQLVESGGGLVQPGGSLRLSCAASGFTFS VNGMHWVRQAPGKGLEWVSVIDGMGHTYYADSVKGRFTISRDNSKNTLYLQMNSLRAEDTAVYYCARYDYIKY GAFDPWGQGTLVTVSS |
| SEQ ID NO: 159 | DNA VL-(GGGGS)4-VH scFv | Gatatcgaactgacccagcctccgagcgttagcgttgcaccgggtcagaccgcacgtattagctgtagcggtgataatattggcagcaaatatg tgcattggtatcagcagaaaccgggtcaggcaccggttctggttatttatggtgatagcaatcgtccgagcggtattccggaacgttttagcggta gcaatagcggtaataccgcaaccctgaccattagcggcacccaggcagaagatgaagcagattattattgtacccgtaccagcaccccgattag cggtgtttttggtggtggcaccaagcttaccgttctgggtggtggtggtagcggtggtggtggctcaggtggtggcggttctggtggcggtggttca caggttcaattggttgaaagtggtggtggtctggttcagcctggtggtagcctgcgtctgagctgtgcagcaagcggttttacctttagcgttaatg gtatgcattgggttcgccaggcaccgggtaaaggtctggaatgggttagcgttattgatggtatgggccatacctattatgccgatagcgttaaa ggtcgttttaccattagccgtgataatagcaaaaataccctgtatctgcagatgaatagcctgcgtgcagaagataccgcagtttattattgcgca cgctatgattatattaaatatggtgcctttgatccgtggggtcagggtacactagttaccgttagcagc |
| SEQ ID NO: 160 | VL-(GGGGS)4-VH scFv | DIELTQPPSVSVAPGQTARISCSGDNIGSKYVHWYQQKPGQAPVLVIYGDSNRPSGIPERFSGSNSGNTATLTISGT QAEDEADYYCTRTSTPISGVFGGGTKLTVLGGGGSGGGGSGGGGSGGGGSQVQLVESGGGLVQPGGSLRLSCAA SGFTFSVNGMHWVRQAPGKGLEWVSVIDGMGHTYYADSVKGRFTISRDNSKNTLYLQMNSLRAEDTAVYYCAR YDYIKYGAFDPWGQGTLVTVSS |
| SEQ ID NO: 161 | DNA VH-(GGGGS)3-VL scFv | Caggttcaattggttgaaagcggtggtggtctggttcagcctggtggtagcctgcgtctgagctgtgcagcaagcggttttacctttagcgttaat ggtatgcattgggttcgtcaggcaccgggtaaaggtctggaatgggttagcgttattgatggtatgggccatacctattatgccgatagcgttaaa ggtcgttttaccattagccgtgataatagcaaaaataccctgtatctgcagatgaatagcctgcgtgcagaagataccgcagtttattattgtgcc cgttatgattatattaaatatggtgcctttgatccgtggggtcagggtacactagttaccgttagcagtggtggtggtggtagcggtggtggcgga tctggtggcggtggttcagatatcgaactgacccagcctccgagcgttagcgttgcaccgggtcagaccgcacgtattagctgtagcggtgataa tattggcagcaaatatgtgcattggtatcagcagaaaccgggtcaggctccggttctggttatttatggtgatagcaatcgtccgagcggtattcc ggaacgttttagcggtagcaatagcggtaataccgcaaccctgaccattagcggcacccaggcagaagatgaagccgattattattgcacccgt accagcaccccgattagcggtgtttttggtggtggcaccaagcttaccgttctg |

TABLE 1-continued

Examples of LRP6 Antibodies of the Present Invention

| SEQ ID NUMBER | Ab region | Sequence |
|---|---|---|
| SEQ ID NO: 162 | VH-(GGGGS)3-VL scFv | QVQLVESGGGLVQPGGSLRLSCAASGFTFSVNGMHWVRQAPGKGLEWVSVIDGMGHTYYADSVKGRFTISRDN<br>SKNTLYLQMNSLRAEDTAVYYCARYDYIKYGAFDPWGQGTLVTVSSGGGGSGGGGSGGGGSDIELTQPPSVSVA<br>PGQTARISCSGDNIGSKYVHWYQQKPGQAPVLVIYGDSNRPSGIPERFSGSNSGNTATLTISGTQAEDEADYYCTR<br>TSTPISGVFGGGTKLTVL |
| SEQ ID NO: 163 | DNA VH-(GGGGS)4-VL scFv | Caggttcaattggttgaaagcggtggtggtctggttcagcctggtggtagcctgcgtctgagctgtgcagcaagcggttttacctttagcgttaat<br>ggtatgcattgggttcgtcaggcaccgggtaaaggtctggaatgggttagcgttattgatggtatgggccatacctattatgccgatagcgttaaa<br>ggtcgttttaccattagccgtgataatagcaaaaataccctgtatctgcagatgaatagcctgcgtgcagaagataccgcagtttattattgtgcc<br>cgttatgattatattaaatatggtgcctttgatccgtggggtcagggtacactagttaccgttagcagtggtggtggtggtagcggtggtggcgga<br>tctggtggcggtggttcaggtggtggtggcagtgatatcgaactgacccagcctccgagcgttagcgttgcaccgggtcagaccgcacgtattag<br>ctgtagcggtgataatattggcagcaaatatgtgcattggtatcagcagaaaccgggtcaggctccggttctggttatttatggtgatagcaatcg<br>tccgagcggtattccggaacgttttagcggtagcaatagcggtaataccgcaaccctgaccattagcggcacccaggcagaagatgaagccga<br>ttattattgcacccgtaccagcaccccgattagcggtgtttttggtggtggcaccaagcttaccgttctg |
| SEQ ID NO: 164 | VH-(GGGGS)-4-VL scFv | QVQLVESGGGLVQPGGSLRLSCAASGFTFSVNGMHWVRQAPGKGLEWVSVIDGMGHTYYADSVKGRFTISRDN<br>SKNTLYLQMNSLRAEDTAVYYCARYDYIKYGAFDPWGQGTLVTVSSGGGGSGGGGSGGGGSGGGGSDIELTQPP<br>SVSVAPGQTARISCSGDNIGSKYVHWYQQKPGQAPVLVIYGDSNRPSGIPERFSGSNSGNTATLTISGTQAEDEAD<br>YYCTRTSTPISGVFGGGTKLTVL |
| Biparatopic MOR08168/MOR06475 | | |
| SEQ ID NO: 165 | DNA Heavy MOR08168 hIgG1 LALA MOR06475 scFv | caggtgcaattggtcgagtctggcggaggactggtgcagcctggtggcagcctgagactgagctgcgccgccagcggcttcaccttcagcgact<br>acgtgatcaactgggtgcgacaggcccctggaaagggcctggaatgggtgtccggcatctcttggtctggcgtgaacacccactacgccgacag<br>cgtgaagggccggttcaccatcagccgggacaacagcaagaacaccctgtacctgcagatgaacagcctgagagccgaggacaccgccgtgt<br>actactgtgccagactgggcgccaccgccaacaacatccggtacaagttcatggacgtgtggggccagggcacactggtgaccgtcagctcag<br>ctagcaccaagggccccagcgtgttccccctggcccccagcagcaagagcaccagcggcggcacagccgccctgggctgcctggtgaaggact<br>acttccccgagcccgtgaccgtgtcctggaacagcggagccctgacctccggcgtgcacaccttccccgccgtgctgcagagcagcggcctgtac<br>agcctgtccagcgtggtgacagtgcccagcagcagcctgggcacccagacctacatctgcaacgtgaaccacaagcccagcaacaccaaggtg<br>gacaagagagtggagcccaagagctgcgacaagacccacacctgccccccctgcccagccccagaggcagcgggcggaccctccgtgttcct<br>gttcccccccaagcccaaggacaccctgatgatcagcaggacccccgaggtgacctgcgtggtggtggacgtgagccacgaggacccagaggt<br>gaagttcaactggtacgtggacggcgtggaggtgcacaacgccaagaccaagcccagagaggagcagtacaacagcacctacagggtggtgt<br>ccgtgctgaccgtgctgcaccaggactggctgaacggcaaggaatacaagtgcaaggtctccaacaaggccctgccagcccccatcgaaaaga<br>ccatcagcaaggccaagggccagccacgggagccccaggtgtacaccctgccccctcccgggaggagatgaccaagaaccaggtgtccctg<br>acctgtctggtgaagggcttctaccccagcgacatcgccgtggagtgggagagcaacggccagcccgagaacaactacaagaccaccccccca<br>gtgctggacagcgacggcagcttcttcctgtacagcaagctgaccgtggacaagtccaggtggcagcagggcaacgtgttcagctgcagcgtga<br>tgcacgaagcgctgcacaaccactacacccagaagagcctgagcctgtcccccggcaagggcggctccggcggaagcgatatcgtgctgacac<br>agagccctgccaccctgtctctgagccctggcgagagagccaccctgagctgccgggccagccagttcatcggctcccgctacctggcctggtat<br>cagcagaagcccggacaggctcccagactgctgatctacggcgccagcaacagagctaccggcgtgcccgccagattttctggcagcggcagc<br>ggcaccgacttcaccctgaccatcagcagcctggaacccgaggacttcgccacctactactgccagcagtactacgactacccccagaccttcg<br>gccagggcaccaaggtggagatcaagggcggaggcggatccgggggtggcggaagtggaggcggaggaagcggagggggcggaagccag<br>gtgcaattgaaagagtccggccctgccctggtgaagcctacccagaccctgaccctgacatgcaccttcagcggcttcagcctgagcaacagag<br>gcggcggagtgggctggatcagacagcctcccggcaaggccctggaatggctggcctggatcgactgggacgacgacaagagctacagcacc<br>agcctgaaaacccggctgaccatctccaaggacaccagcaagaaccaggtggtgctcaccatgaccaacatggaccccgtggacaccgccac<br>ctattattgcgcccggatgcatctgccccctggtgttcgatagctggggccagggaaccctggtgacagtgtccagc |

TABLE 1-continued

Examples of LRP6 Antibodies of the Present Invention

| SEQ ID NUMBER | Ab region | Sequence |
|---|---|---|
| SEQ ID NO: 166 | Heavy MOR08168 hIgG1 LALA MOR06475 scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEALHNHYTQKSLSLSP GKGGSGGSDIVLTQSPATLSLSPGERATLSCRASQFIGSRYLAWYQQKPGQAPRLLIYGASNRATGVPARFSGSGSG TDFTLTISSLEPEDFATYYCQQYYDYPQTFGQGTKVEIKGGGGSGGGGSGGGGSGGGGSQVQLKESGPALVKPTQ TLTLTCTFSGFSLSNRGGGVGWIRQPPGKALEWLAWIDWDDDKSYSTSLKTRLTISKDTSKNQVVLTMTNMDPV DTATYYCARMHLPLVFDSWGQGTLVTVSS |
| SEQ ID NO: 167 | VL MOR08168 | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVL |
| SEQ ID NO: 168 | DNA VL MOR08168 | GACATCGAGCTGACCCAGCCCCCTTCTGTGTCTGTGGCCCCTGGCCAGACCGCCAGAATCAGCTGCAGCGGC GACAGCCTGCGGAACAAGGTGTACTGGTATCAGCAGAAGCCCGGCCAGGCTCCCGTGCTGGTGATCTACAAG AACAACCGGCCCAGCGGCATCCCTGAGCGGTTCAGCGGCAGCAACAGCGGCAATACCGCCACCCTGACCATC AGCGGCACCCAGGCCGAAGATGAGGCCGACTACTACTGCCAGAGCTACGACGGCCAGAAAAGCCTGGTGTT CGGCGGAGGCACCAAGCTTACCGTGCTG |
| SEQ ID NO: 169 | DNA Light lambda MOR08168 | Gacatcgagctgacccagcccccttctgtgtctgtggcccctggccagaccgccagaatcagctgcagcggcgacagcctgcggaacaaggtg tactggtatcagcagaagcccggccaggctcccgtgctggtgatctacaagaacaaccggcccagcggcatccctgagcggttcagcggcagc aacagcggcaataccgccaccctgaccatcagcggcacccaggccgaagatgaggccgactactactgccagagctacgacggccagaaaag cctggtgttcggcggaggcaccaagcttaccgtgctgggccagcccaaagccgcccctagcgtgaccctgttcccccccagcagcgaggaactg caggccaacaaggccaccctggtctgcctgatcagcgacttctaccctggcgccgtgaccgtggcctggaaggccgacagcagccccgtgaag gccggcgtggagacaaccaccccccagcaagcagagcaacaacaagtacgccgccagcagctacctgagcctgacccccgagcagtggaaga gccacagaagctacagctgccaggtcacccacgagggcagcaccgtggagaaaaccgtggcccccaccgagtgcagc |
| SEQ ID NO: 170 | Light lambda MOR08168 | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |
| SEQ ID NO: 171 | Heavy MOR08168 hIgG1 LALA (w/o K) MOR06475 scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEALHNHYTQKSLSLSP GGGSGGSDIVLTQSPATLSLSPGERATLSCRASQFIGSRYLAWYQQKPGQAPRLLIYGASNRATGVPARFSGSGSGT DFTLTISSLEPEDFATYYCQQYYDYPQTFGQGTKVEIKGGGGSGGGGSGGGGSGGGGSQVQLKESGPALVKPTQT LTLTCTFSGFSLSNRGGGVGWIRQPPGKALEWLAWIDWDDDKSYSTSLKTRLTISKDTSKNQVVLTMTNMDPVD TATYYCARMHLPLVFDSWGQGTLVTVSS |
| SEQ ID NO: 172 | DNA Heavy MOR08168 hIgG1 LALA (w/o K) MOR06475 | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT |

TABLE 1-continued

Examples of LRP6 Antibodies of the Present Invention

| SEQ ID NUMBER | Ab region | Sequence |
|---|---|---|
| | scFv | GACCGTCAGCTCAGCTAGCACCAAGGGCCCCAGCGTGTTCCCCCTGGCCCCCAGCAGCAAGAGCACCAGCGG CGGCACAGCCGCCCTGGGCTGCCTGGTGAAGGACTACTTCCCCGAGCCCGTGACCGTGTCCTGGAACAGCGG AGCCCTGACCTCCGGCGTGCACACCTTCCCCGCCGTGCTGCAGAGCAGCGGCCTGTACAGCCTGTCCAGCGTG GTGACAGTGCCCAGCAGCAGCCTGGGCACCCAGACCTACATCTGCAACGTGAACCACAAGCCCAGCAACACC AAGGTGGACAAGAGAGTGGAGCCCAAGAGCTGCGACAAGACCCACACCTGCCCCCCCTGCCCAGCCCCAGA GGCAGCGGGCGGACCCTCCGTGTTCCTGTTCCCCCCCAAGCCCAAGGACACCCTGATGATCAGCAGGACCCCC GAGGTGACCTGCGTGGTGGTGGACGTGAGCCACGAGGACCCAGAGGTGAAGTTCAACTGGTACGTGGACGG CGTGGAGGTGCACAACGCCAAGACCAAGCCCAGAGAGGAGCAGTACAACAGCACCTACAGGGTGGTGTCCG TGCTGACCGTGCTGCACCAGGACTGGCTGAACGGCAAGGAATACAAGTGCAAGGTCTCCAACAAGGCCCTGC CAGCCCCCATCGAAAAGACCATCAGCAAGGCCAAGGGCCAGCCACGGGAGCCCCAGGTGTACACCCTGCCCC CCTCCCGGGAGGAGATGACCAAGAACCAGGTGTCCCTGACCTGTCTGGTGAAGGGCTTCTACCCCAGCGACA TCGCCGTGGAGTGGGAGAGCAACGGCCAGCCCGAGAACAACTACAAGACCACCCCCCCAGTGCTGGACAGC GACGGCAGCTTCTTCCTGTACAGCAAGCTGACCGTGGACAAGTCCAGGTGGCAGCAGGGCAACGTGTTCAGC TGCAGCGTGATGCACGAAGCGCTGCACAACCACTACACCCAGAAGAGCCTGAGCCTGTCCCCCGGCGGCGGC TCCGGCGGAAGCGATATCGTGCTGACACAGAGCCCTGCCACCCTGTCTCTGAGCCCTGGCGAGAGAGCCACC CTGAGCTGCCGGGCCAGCCAGTTCATCGGCTCCCGCTACCTGGCCTGGTATCAGCAGAAGCCCGGACAGGCT CCCAGACTGCTGATCTACGGCGCCAGCAACAGAGCTACCGGCGTGCCCGCCAGATTTTCTGGCAGCGGCAGC GGCACCGACTTCACCCTGACCATCAGCAGCCTGGAACCCGAGGACTTCGCCACCTACTACTGCCAGCAGTACT ACGACTACCCCCAGACCTTCGGCCAGGGCACCAAGGTGGAGATCAAGGGCGGAGGCGGATCCGGGGGTGG CGGAAGTGGAGGCGGAGGAAGCGGAGGGGGCGGAAGCCAGGTGCAATTGAAAGAGTCCGGCCCTGCCCTG GTGAAGCCTACCCAGACCCTGACCCTGACATGCACCTTCAGCGGCTTCAGCCTGAGCAACAGAGGCGGCGGA GTGGGCTGGATCAGACAGCCTCCCGGCAAGGCCCTGGAATGGCTGGCCTGGATCGACTGGGACGACGACAA GAGCTACAGCACCAGCCTGAAAACCCGGCTGACCATCTCCAAGGACACCAGCAAGAACCAGGTGGTGCTCAC CATGACCAACATGGACCCCGTGGACACCGCCACCTATTATTGCGCCCGGATGCATCTGCCCCTGGTGTTCGAT AGCTGGGGCCAGGGAACCCTGGTGACAGTGTCCAGC |
| SEQ ID NO: 173 | Heavy MOR08168 hIgG1 LALA MOR06475 scFv (DP to DA) | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEALHNHYTQKSLSLSP GKGGSGGSDIVLTQSPATLSLSPGERATLSCRASQFIGSRYLAWYQQKPGQAPRLLIYGASNRATGVPARFSGSGSG TDFTLTISSLEPEDFATYYCQQYYDYPQTFGQGTKVEIKGGGGSGGGGSGGGGSGGGGSQVQLKESGPALVKPTQ TLTLTCTFSGFSLSNRGGGVGWIRQPPGKALEWLAWIDWDDDKSYSTSLKTRLTISKDTSKNQVVLTMTNMDAV DTATYYCARMHLPLVFDSWGQGTLVTVSS |
| SEQ ID NO: 174 | DNA Heavy MOR08168 hIgG1 LALA MOR06475 scFv (DP to DA) | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT GACCGTCAGCTCAGCTAGCACCAAGGGCCCCAGCGTGTTCCCCCTGGCCCCCAGCAGCAAGAGCACCAGCGG CGGCACAGCCGCCCTGGGCTGCCTGGTGAAGGACTACTTCCCCGAGCCCGTGACCGTGTCCTGGAACAGCGG AGCCCTGACCTCCGGCGTGCACACCTTCCCCGCCGTGCTGCAGAGCAGCGGCCTGTACAGCCTGTCCAGCGTG GTGACAGTGCCCAGCAGCAGCCTGGGCACCCAGACCTACATCTGCAACGTGAACCACAAGCCCAGCAACACC AAGGTGGACAAGAGAGTGGAGCCCAAGAGCTGCGACAAGACCCACACCTGCCCCCCCTGCCCAGCCCCAGA GGCAGCGGGCGGACCCTCCGTGTTCCTGTTCCCCCCCAAGCCCAAGGACACCCTGATGATCAGCAGGACCCCC |

TABLE 1-continued

Examples of LRP6 Antibodies of the Present Invention

| SEQ ID NUMBER | Ab region | Sequence |
| --- | --- | --- |
| | | GAGGTGACCTGCGTGGTGGTGGACGTGAGCCACGAGGACCCAGAGGTGAAGTTCAACTGGTACGTGGACGG<br>CGTGGAGGTGCACAACGCCAAGACCAAGCCCAGAGAGGAGCAGTACAACAGCACCTACAGGGTGGTGTCCG<br>TGCTGACCGTGCTGCACCAGGACTGGCTGAACGGCAAGGAATACAAGTGCAAGGTCTCCAACAAGGCCCTGC<br>CAGCCCCCATCGAAAAGACCATCAGCAAGGCCAAGGGCCAGCCACGGGAGCCCCAGGTGTACACCCTGCCCC<br>CCTCCCGGGAGGAGATGACCAAGAACCAGGTGTCCCTGACCTGTCTGGTGAAGGGCTTCTACCCCAGCGACA<br>TCGCCGTGGAGTGGGAGAGCAACGGCCAGCCCGAGAACAACTACAAGACCACCCCCCCAGTGCTGGACAGC<br>GACGGCAGCTTCTTCCTGTACAGCAAGCTGACCGTGGACAAGTCCAGGTGGCAGCAGGGCAACGTGTTCAGC<br>TGCAGCGTGATGCACGAAGCGCTGCACAACCACTACACCCAGAAGAGCCTGAGCCTGTCCCCCGGCAAGGGC<br>GGCTCCGGCGGAAGCGATATCGTGCTGACACAGAGCCCTGCCACCCTGTCTCTGAGCCCTGGCGAGAGAGCC<br>ACCCTGAGCTGCCGGGCCAGCCAGTTCATCGGCTCCCGCTACCTGGCCTGGTATCAGCAGAAGCCCGGACAG<br>GCTCCCAGACTGCTGATCTACGGCGCCAGCAACAGAGCTACCGGCGTGCCCGCCAGATTTTCTGGCAGCGGC<br>AGCGGCACCGACTTCACCCTGACCATCAGCAGCCTGGAACCCGAGGACTTCGCCACCTACTACTGCCAGCAGT<br>ACTACGACTACCCCCAGACCTTCGGCCAGGGCACCAAGGTGGAGATCAAGGGCGGAGGCGGATCCGGGGGT<br>GGCGGAAGTGGAGGCGGAGGAAGCGGAGGGGGCGGAAGCCAGGTGCAATTGAAAGAGTCCGGCCCTGCC<br>CTGGTGAAGCCTACCCAGACCCTGACCCTGACATGCACCTTCAGCGGCTTCAGCCTGAGCAACAGAGGCGGC<br>GGAGTGGGCTGGATCAGACAGCCTCCCGGCAAGGCCCTGGAATGGCTGGCCTGGATCGACTGGGACGACGA<br>CAAGAGCTACAGCACCAGCCTGAAAACCCGGCTGACCATCTCCAAGGACACCAGCAAGAACCAGGTGGTGCT<br>CACCATGACCAACATGGACGCCGTGGACACCGCCACCTATTATTGCGCCCGGATGCATCTGCCCCTGGTGTTC<br>GATAGCTGGGGCCAGGGAACCCTGGTGACAGTGTCCAGC |
| SEQ ID NO: 175 | Heavy<br>MOR08168<br>hIgG1 LALA<br>MOR06475<br>scFv (DP to TA) | QVQLVESGGGLVQPGGSLRLSCAASGFTFSDYVINWVRQAPGKGLEWVSGISWSGVNTHYADSVKGRFTISRDN<br>SKNTLYLQMNSLRAEDTAVYYCARLGATANNIRYKFMDVWGQGTLVTVSSASTKGPSVFPLAPSSKSTSGGTAAL<br>GCLVKDYFPEPVTVSWNSGALTSGVHTFPAVLQSSGLYSLSSVVTVPSSSLGTQTYICNVNHKPSNTKVDKRVEPKS<br>CDKTHTCPPCPAPEAAGGPSVFLFPPKPKDTLMISRTPEVTCVVVDVSHEDPEVKFNWYVDGVEVHNAKTKPREE<br>QYNSTYRVVSVLTVLHQDWLNGKEYKCKVSNKALPAPIEKTISKAKGQPREPQVYTLPPSREEMTKNQVSLTCLVK<br>GFYPSDIAVEWESNGQPENNYKTTPPVLDSDGSFFLYSKLTVDKSRWQQGNVFSCSVMHEALHNHYTQKSLSLSP<br>GKGGSGGSDIVLTQSPATLSLSPGERATLSCRASQFIGSRYLAWYQQKPGQAPRLLIYGASNRATGVPARFSGSGSG<br>TDFTLTISSLEPEDFATYYCQQYYDYPQTFGQGTKVEIKGGGGSGGGGSGGGGSGGGGSQVQLKESGPALVKPTQ<br>TLTLTCTFSGFSLSNRGGGVGWIRQPPGKALEWLAWIDWDDDKSYSTSLKTRLTISKDTSKNQVVLTMTNMTAVD<br>TATYYCARMHLPLVFDSWGQGTLVTVSS |
| SEQ ID NO: 176 | DNA Heavy<br>MOR08168<br>hIgG1 LALA<br>MOR06475<br>scFv (DP to TA) | CAGGTGCAATTGGTCGAGTCTGGCGGAGGACTGGTGCAGCCTGGTGGCAGCCTGAGACTGAGCTGCGCCGC<br>CAGCGGCTTCACCTTCAGCGACTACGTGATCAACTGGGTGCGACAGGCCCCTGGAAAGGGCCTGGAATGGGT<br>GTCCGGCATCTCTTGGTCTGGCGTGAACACCCACTACGCCGACAGCGTGAAGGGCCGGTTCACCATCAGCCG<br>GGACAACAGCAAGAACACCCTGTACCTGCAGATGAACAGCCTGAGAGCCGAGGACACCGCCGTGTACTACTG<br>TGCCAGACTGGGCGCCACCGCCAACAACATCCGGTACAAGTTCATGGACGTGTGGGGCCAGGGCACACTGGT<br>GACCGTCAGCTCAGCTAGCACCAAGGGCCCCAGCGTGTTCCCCCTGGCCCCCAGCAGCAAGAGCACCAGCGG<br>CGGCACAGCCGCCCTGGGCTGCCTGGTGAAGGACTACTTCCCCGAGCCCGTGACCGTGTCCTGGAACAGCGG<br>AGCCCTGACCTCCGGCGTGCACACCTTCCCCGCCGTGCTGCAGAGCAGCGGCCTGTACAGCCTGTCCAGCGTG<br>GTGACAGTGCCCAGCAGCAGCCTGGGCACCCAGACCTACATCTGCAACGTGAACCACAAGCCCAGCAACACC<br>AAGGTGGACAAGAGAGTGGAGCCCAAGAGCTGCGACAAGACCCACACCTGCCCCCCCTGCCCAGCCCCAGA<br>GGCAGCGGGCGGACCCTCCGTGTTCCTGTTCCCCCCCAAGCCCAAGGACACCCTGATGATCAGCAGGACCCCC<br>GAGGTGACCTGCGTGGTGGTGGACGTGAGCCACGAGGACCCAGAGGTGAAGTTCAACTGGTACGTGGACGG<br>CGTGGAGGTGCACAACGCCAAGACCAAGCCCAGAGAGGAGCAGTACAACAGCACCTACAGGGTGGTGTCCG<br>TGCTGACCGTGCTGCACCAGGACTGGCTGAACGGCAAGGAATACAAGTGCAAGGTCTCCAACAAGGCCCTGC<br>CAGCCCCCATCGAAAAGACCATCAGCAAGGCCAAGGGCCAGCCACGGGAGCCCCAGGTGTACACCCTGCCCC<br>CCTCCCGGGAGGAGATGACCAAGAACCAGGTGTCCCTGACCTGTCTGGTGAAGGGCTTCTACCCCAGCGACA<br>TCGCCGTGGAGTGGGAGAGCAACGGCCAGCCCGAGAACAACTACAAGACCACCCCCCCAGTGCTGGACAGC |

TABLE 1-continued

Examples of LRP6 Antibodies of the Present Invention

| SEQ ID NUMBER | Ab region | Sequence |
| --- | --- | --- |
| | | GACGGCAGCTTCTTCCTGTACAGCAAGCTGACCGTGGACAAGTCCAGGTGGCAGCAGGGCAACGTGTTCAGC TGCAGCGTGATGCACGAAGCGCTGCACAACCACTACACCCAGAAGAGCCTGAGCCTGTCCCCCGGCAAGGGC GGCTCCGGCGGAAGCGATATCGTGCTGACACAGAGCCCTGCCACCCTGTCTCTGAGCCCTGGCGAGAGAGCC ACCCTGAGCTGCCGGGCCAGCCAGTTCATCGGCTCCCGCTACCTGGCCTGGTATCAGCAGAAGCCCGGACAG GCTCCCAGACTGCTGATCTACGGCGCCAGCAACAGAGCTACCGGCGTGCCCGCCAGATTTTCTGGCAGCGGC AGCGGCACCGACTTCACCCTGACCATCAGCAGCCTGGAACCCGAGGACTTCGCCACCTACTACTGCCAGCAGT ACTACGACTACCCCCAGACCTTCGGCCAGGGCACCAAGGTGGAGATCAAGGGCGGAGGCGGATCCGGGGGT GGCGGAAGTGGAGGCGGAGGAAGCGGAGGGGGCGGAAGCCAGGTGCAATTGAAAGAGTCCGGCCCTGCC CTGGTGAAGCCTACCCAGACCCTGACCCTGACATGCACCTTCAGCGGCTTCAGCCTGAGCAACAGAGGCGGC GGAGTGGGCTGGATCAGACAGCCTCCCGGCAAGGCCCTGGAATGGCTGGCCTGGATCGACTGGGACGACGA CAAGAGCTACAGCACCAGCCTGAAAACCCGGCTGACCATCTCCAAGGACACCAGCAAGAACCAGGTGGTGCT CACCATGACCAACATGACCGCCGTGGACACCGCCACCTATTATTGCGCCCGGATGCATCTGCCCCTGGTGTTC GATAGCTGGGGCCAGGGAACCCTGGTGACAGTGTCCAGC |
| SEQ ID NO: 177 | Light MOR06475 scFv MOR08168 lambda | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKGGGGSGGGGSGGGGSGGGGSQVQLKESGPALVKPTQTLTLTCTFS GFSLSNRGGGVGWIRQPPGKALEWLAWIDWDDDKSYSTSLKTRLTISKDTSKNQVVLTMTNMDPVDTATYYCAR MHLPLVFDSWGQGTLVTVSSGGSGGSDIELTQPPSVSVAPGQTARISCSGDSLRNKVYWYQQKPGQAPVLVIYKN NRPSGIPERFSGSNSGNTATLTISGTQAEDEADYYCQSYDGQKSLVFGGGTKLTVLGQPKAAPSVTLFPPSSEELQA NKATLVCLISDFYPGAVTVAWKADSSPVKAGVETTTPSKQSNNKYAASSYLSLTPEQWKSHRSYSCQVTHEGSTVE KTVAPTECS |
| SEQ ID NO: 178 | DNA Light MOR06475 scFv MOR08168 lambda | GATATCGTGCTGACACAGAGCCCTGCCACCCTGTCTCTGAGCCCTGGCGAGAGAGCCACCCTGAGCTGCCGG GCCAGCCAGTTCATCGGCTCCCGCTACCTGGCCTGGTATCAGCAGAAGCCCGGACAGGCTCCCAGACTGCTG ATCTACGGCGCCAGCAACAGAGCTACCGGCGTGCCCGCCAGATTTTCTGGCAGCGGCAGCGGCACCGACTTC ACCCTGACCATCAGCAGCCTGGAACCCGAGGACTTCGCCACCTACTACTGCCAGCAGTACTACGACTACCCCC AGACCTTCGGCCAGGGCACCAAGGTGGAGATCAAGGGCGGAGGCGGATCCGGGGGTGGCGGAAGTGGAG GCGGAGGAAGCGGAGGGGGCGGAAGCCAGGTGCAATTGAAAGAGTCCGGCCCTGCCCTGGTGAAGCCTAC CCAGACCCTGACCCTGACATGCACCTTCAGCGGCTTCAGCCTGAGCAACAGAGGCGGCGGAGTGGGCTGGAT CAGACAGCCTCCCGGCAAGGCCCTGGAATGGCTGGCCTGGATCGACTGGGACGACGACAAGAGCTACAGCA CCAGCCTGAAAACCCGGCTGACCATCTCCAAGGACACCAGCAAGAACCAGGTGGTGCTCACCATGACCAACA TGGACCCCGTGGACACCGCCACCTATTATTGCGCCCGGATGCATCTGCCCCTGGTGTTCGATAGCTGGGGCCA GGGAACCCTGGTGACAGTGTCCAGCGGCGGCTCCGGCGGAAGCGACATCGAGCTGACCCAGCCCCCTTCTGT GTCTGTGGCGCCCGGGCAGACCGCCAGAATCAGCTGCAGCGGCGACAGCCTGCGGAACAAGGTGTACTGGT ATCAGCAGAAGCCCGGCCAGGCTCCCGTGCTGGTGATCTACAAGAACAACCGGCCCAGCGGCATCCCTGAGC GGTTCAGCGGCAGCAACAGCGGCAATACCGCCACCCTGACCATCAGCGGCACCCAGGCCGAAGATGAGGCC GACTACTACTGCCAGAGCTACGACGGCCAGAAAAGCCTGGTGTTCGGCGGAGGCACCAAGCTTACCGTGCTG GGCCAGCCCAAAGCCGCCCCTAGCGTGACCCTGTTCCCCCCCAGCAGCGAGGAACTGCAGGCCAACAAGGCC ACCCTGGTCTGCCTGATCAGCGACTTCTACCCTGGCGCCGTGACCGTGGCCTGGAAGGCCGACAGCAGCCCC GTGAAGGCCGGCGTGGAGACAACCACCCCCAGCAAGCAGAGCAACAACAAGTACGCCGCCAGCAGCTACCT GAGCCTGACCCCCGAGCAGTGGAAGAGCCACAGAAGCTACAGCTGCCAGGTCACCCACGAGGGCAGCACCG TGGAGAAAACCGTGGCCCCCACCGAGTGCAGC |
| SEQ ID NO: 179 | VH MOR08168 | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSS |

TABLE 1-continued

| SEQ ID NUMBER | Ab region | Sequence |
|---|---|---|
| | | Examples of LRP6 Antibodies of the Present Invention |
| SEQ ID NO: 180 | DNA VH MOR08168 | Caggtgcaattggtcgagtctggcggaggactggtgcagcctggtggcagcctgagactgagctgcgccgccagcggcttcaccttcagcgact acgtgatcaactgggtgcgacaggcccctggaaagggcctggaatgggtgtccggcatctcttggtctggcgtgaacacccactacgccgacag cgtgaagggccggttcaccatcagccgggacaacagcaagaacaccctgtacctgcagatgaacagcctgagagccgaggacaccgccgtgt actactgtgccagactgggcgccaccgccaacaacatccggtacaagttcatggacgtgtggggccagggcacactggtgaccgtcagctca |
| SEQ ID NO: 181 | Heavy MOR08168 hIgG1 LALA | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEALHNHYTQKSLSLSP GK |
| SEQ ID NO: 182 | DNA Heavy MOR08168 hIgG1 LALA | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT GACCGTCAGCTCAGCTAGCACCAAGGGCCCCAGCGTGTTCCCCCTGGCCCCCAGCAGCAAGAGCACCAGCGG CGGCACAGCCGCCCTGGGCTGCCTGGTGAAGGACTACTTCCCCGAGCCCGTGACCGTGTCCTGGAACAGCGG AGCCCTGACCTCCGGCGTGCACACCTTCCCCGCCGTGCTGCAGAGCAGCGGCCTGTACAGCCTGTCCAGCGTG GTGACAGTGCCCAGCAGCAGCCTGGGCACCCAGACCTACATCTGCAACGTGAACCACAAGCCCAGCAACACC AAGGTGGACAAGAGAGTGGAGCCCAAGAGCTGCGACAAGACCCACACCTGCCCCCCCTGCCCAGCCCCAGA GGCAGCGGGCGGACCCTCCGTGTTCCTGTTCCCCCCCAAGCCCAAGGACACCCTGATGATCAGCAGGACCCCC GAGGTGACCTGCGTGGTGGTGGACGTGAGCCACGAGGACCCAGAGGTGAAGTTCAACTGGTACGTGGACGG CGTGGAGGTGCACAACGCCAAGACCAAGCCCAGAGAGGAGCAGTACAACAGCACCTACAGGGTGGTGTCCG TGCTGACCGTGCTGCACCAGGACTGGCTGAACGGCAAGGAATACAAGTGCAAGGTCTCCAACAAGGCCCTGC CAGCCCCCATCGAAAAGACCATCAGCAAGGCCAAGGGCCAGCCACGGGAGCCCCAGGTGTACACCCTGCCCC CCTCCCGGGAGGAGATGACCAAGAACCAGGTGTCCCTGACCTGTCTGGTGAAGGGCTTCTACCCCAGCGACA TCGCCGTGGAGTGGGAGAGCAACGGCCAGCCCGAGAACAACTACAAGACCACCCCCCCAGTGCTGGACAGC GACGGCAGCTTCTTCCTGTACAGCAAGCTGACCGTGGACAAGTCCAGGTGGCAGCAGGGCAACGTGTTCAGC TGCAGCGTGATGCACGAGGCCCTGCACAACCACTACACCCAGAAGAGCCTGAGCCTGTCCCCCGGCAAG |
| SEQ ID NO: 183 | VL MOR06475 | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIK |
| SEQ ID NO: 184 | DNA VL MOR06475 | Gatatcgtgctgacccagagcccggcgaccctgagcctgtctccgggcgaacgtgcgaccctgagctgcagagcgagccagtttattggttctc gttatctggcttggtaccagcagaaaccaggtcaagcaccgcgtctattaatttatggtgcttctaatcgtgcaactggggtcccggcgcgttttag cggctctggatccggcacggattttaccctgaccattagcagcctggaacctgaagactttgcgacttattattgccagcagtattatgattatcct cagacctttggccagggtacgaaagttgaaattaaa |
| SEQ ID NO: 185 | Light MOR06475 kappa | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKRTVAAPSVFIFPPSDEQLKSGTASVVCLLNNFYPREAKVQWKVDNAL QSGNSQESVTEQDSKDSTYSLSSTLTLSKADYEKHKVYACEVTHQGLSSPVTKSFNRGEC |

TABLE 1-continued

Examples of LRP6 Antibodies of the Present Invention

| SEQ ID NUMBER | Ab region | Sequence |
|---|---|---|
| SEQ ID NO: 186 | DNA Light MOR06475 kappa | GATATCGTGCTGACCCAGAGCCCGGCGACCCTGAGCCTGTCTCCGGGCGAACGTGCGACCCTGAGCTGCAGA GCGAGCCAGTTTATTGGTTCTCGTTATCTGGCTTGGTACCAGCAGAAACCAGGTCAAGCACCGCGTCTATTAA TTTATGGTGCTTCTAATCGTGCAACTGGGGTCCCGGCGCGTTTTAGCGGCTCTGGATCCGGCACGGATTTTAC CCTGACCATTAGCAGCCTGGAACCTGAAGACTTTGCGACTTATTATTGCCAGCAGTATTATGATTATCCTCAGA CCTTTGGCCAGGGTACGAAAGTTGAAATTAAACGTACGGTGGCCGCTCCCAGCGTGTTCATCTTCCCCCCCAG CGACGAGCAGCTGAAGAGCGGCACCGCCAGCGTGGTGTGCCTGCTGAACAACTTCTACCCCCGGGAGGCCA AGGTGCAGTGGAAGGTGGACAACGCCCTGCAGAGCGGCAACAGCCAGGAGAGCGTCACCGAGCAGGACAG CAAGGACTCCACCTACAGCCTGAGCAGCACCCTGACCCTGAGCAAGGCCGACTACGAGAAGCATAAGGTGTA CGCCTGCGAGGTGACCCACCAGGGCCTGTCCAGCCCCGTGACCAAGAGCTTCAACAGGGGCGAGTGC |
| SEQ ID NO: 187 | Heavy MOR06475 hIgG1LALA MOR08168 scFv (VH-3-VL) | QVQLKESGPALVKPTQTLTLTCTFSGFSLSNRGGGVGWIRQPPGKALEWLAWIDWDDDKSYSTSLKTRLTISKDTS KNQVVLTMTNMDPVDTATYYCARMHLPLVFDSWGQGTLVTVSSASTKGPSVFPLAPSSKSTSGGTAALGCLVKD YFPEPVTVSWNSGALTSGVHTFPAVLQSSGLYSLSSVVTVPSSSLGTQTYICNVNHKPSNTKVDKRVEPKSCDKTHT CPPCPAPEAAGGPSVFLFPPKPKDTLMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEALHNHYTQKSLSLSPGKGGSG GSQVQLVESGGGLVQPGGSLRLSCAASGFTFSDYVINWVRQAPGKGLEWVSGISWSGVNTHYADSVKGRFTISR DNSKNTLYLQMNSLRAEDTAVYYCARLGATANNIRYKFMDVWGQGTLVTVSSGGGGSGGGGSGGGGSDIELTQ PPSVSVAPGQTARISCSGDSLRNKVYWYQQKPGQAPVLVIYKNNRPSGIPERFSGSNSGNTATLTISGTQAEDEAD YYCQSYDGQKSLVFGGGTKLTVL |
| SEQ ID NO: 188 | DNA Heavy MOR06475 hIgG1LALA MOR08168 scFv (VH-3-VL) | CAGGTGCAATTGAAAGAAAGCGGCCCGGCCCTGGTGAAACCGACCCAAACCCTGACCCTGACCTGTACCTTTT CCGGATTTAGCCTGTCTAATCGTGGTGGTGGTGTGGGTTGGATTCGCCAGCCGCCTGGGAAAGCCCTCGAGT GGCTGGCTTGGATCGATTGGGATGATGATAAGTCTTATAGCACCAGCCTGAAAACGCGTCTGACCATTAGCA AAGATACTTCGAAAAATCAGGTGGTGCTGACTATGACCAACATGGACCCGGTGGATACGGCCACCTATTATTG CGCGCGTATGCATCTTCCTCTTGTTTTTGATTCTTGGGGCCAAGGCACCCTGGTGACGGTTAGCTCAGCTAGCA CCAAGGGCCCCAGCGTGTTCCCCCTGGCCCCCAGCAGCAAGAGCACCAGCGGCGGCACAGCCGCCCTGGGCT GCCTGGTGAAGGACTACTTCCCCGAGCCCGTGACCGTGTCCTGGAACAGCGGAGCCCTGACCTCCGGCGTGC ACACCTTCCCCGCCGTGCTGCAGAGCAGCGGCCTGTACAGCCTGTCCAGCGTGGTGACAGTGCCCAGCAGCA GCCTGGGCACCCAGACCTACATCTGCAACGTGAACCACAAGCCCAGCAACACCAAGGTGGACAAGAGAGTG GAGCCCAAGAGCTGCGACAAGACCCACACCTGCCCCCCCTGCCCAGCCCCAGAGGCAGCGGGCGGACCCTCC GTGTTCCTGTTCCCCCCCAAGCCCAAGGACACCCTGATGATCAGCAGGACCCCCGAGGTGACCTGCGTGGTG GTGGACGTGAGCCACGAGGACCCAGAGGTGAAGTTCAACTGGTACGTGGACGGCGTGGAGGTGCACAACGC CAAGACCAAGCCCAGAGAGGAGCAGTACAACAGCACCTACAGGGTGGTGTCCGTGCTGACCGTGCTGCACCA GGACTGGCTGAACGGCAAGGAATACAAGTGCAAGGTCTCCAACAAGGCCCTGCCAGCCCCCATCGAAAAGAC CATCAGCAAGGCCAAGGGCCAGCCACGGGAGCCCCAGGTGTACACCCTGCCCCCCTCCCGGGAGGAGATGA CCAAGAACCAGGTGTCCCTGACCTGTCTGGTGAAGGGCTTCTACCCCAGCGACATCGCCGTGGAGTGGGAGA GCAACGGCCAGCCCGAGAACAACTACAAGACCACCCCCCCAGTGCTGGACAGCGACGGCAGCTTCTTCCTGT ACAGCAAGCTGACCGTGGACAAGTCCAGGTGGCAGCAGGGCAACGTGTTCAGCTGCAGCGTGATGCACGAA GCGCTGCACAACCACTACACCCAGAAGAGCCTGAGCCTGTCCCCCGGCAAGGGCGGCTCCGGCGGAAGCCA GGTTCAATTGGTTGAAAGCGGTGGTGGTCTGGTTCAGCCTGGTGGTAGCCTGCGTCTGAGCTGTGCAGCAAG CGGTTTTACCTTTAGCGATTATGTGATTAATTGGGTTCGTCAGGCACCGGGTAAAGGTCTGGAATGGGTTAGC GGTATTAGCTGGTCAGGTGTTAATACCCATTATGCAGATAGCGTGAAAGGTCGTTTTACCATTAGCCGTGATA ATAGCAAAAATACCCTGTATCTGCAGATGAATAGCCTGCGTGCAGAAGATACCGCAGTTTATTATTGTGCACG TCTGGGTGCAACCGCAAATAATATTCGCTATAAATTTATGGATGTGTGGGGTCAGGGTACACTAGTTACCGTT AGCAGTGGTGGTGGTGGTAGCGGTGGTGGCGGATCTGGTGGCGGTGGCAGTGATATCGAACTGACCCAGCC TCCGAGCGTTAGCGTTGCACCGGGTCAGACCGCACGTATTAGCTGTAGCGGTGATAGTCTGCGTAATAAAGTT |

TABLE 1-continued

| SEQ ID NUMBER | Ab region | Sequence |
|---|---|---|
| Examples of LRP6 Antibodies of the Present Invention | | |
| | | TATTGGTATCAGCAGAAACCGGGTCAGGCTCCGGTTCTGGTTATTTATAAAAATAATCGTCCGAGCGGTATTC<br>CGGAACGTTTTAGCGGTAGCAATAGCGGTAATACCGCAACCCTGACCATTAGCGGCACCCAGGCAGAAGATG<br>AAGCCGATTATTATTGTCAGAGCTATGATGGTCAGAAAAGCCTGGTTTTTGGTGGTGGCACCAAGCTTACCGT<br>TCTG |
| SEQ ID NO: 189 | Heavy<br>MOR06475<br>hIgG1 LALA<br>MOR08168<br>scFv (VH-4-VL) | QVQLKESGPALVKPTQTLTLTCTFSGFSLSNRGGGVGWIRQPPGKALEWLAWIDWDDDKSYSTSLKTRLTISKDTS<br>KNQVVLTMTNMDPVDTATYYCARMHLPLVFDSWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYICNVNHKPSNTKVDKRVEPKSCDKTHT<br>CPPCPAPEAAGGPSVFLFPPKPKDTLMISRTPEVTCVVVDVSHEDPEVKFNWYVDGVEVHNAKTKPREEQYNSTY<br>RVVSVLTVLHQDWLNGKEYKCKVSNKALPAPIEKTISKAKGQPREPQVYTLPPSREEMTKNQVSLTCLVKGFYPSDI<br>AVEWESNGQPENNYKTTPPVLDSDGSFFLYSKLTVDKSRWQQGNVFSCSVMHEALHNHYTQKSLSLSPGKGGSG<br>GSQVQLVESGGGLVQPGGSLRLSCAASGFTFSDYVINWVRQAPGKGLEWVSGISWSGVNTHYADSVKGRFTISR<br>DNSKNTLYLQMNSLRAEDTAVYYCARLGATANNIRYKFMDVWGQGTLVTVSSGGGGSGGGGSGGGGSGGGGS<br>DIELTQPPSVSVAPGQTARISCSGDSLRNKVYWYQQKPGQAPVLVIYKNNRPSGIPERFSGSNSGNTATLTISGTQA<br>EDEADYYCQSYDGQKSLVFGGGTKLTVL |
| SEQ ID NO: 190 | DNA Heavy<br>MOR06475<br>hIgG1 LALA<br>MOR08168<br>scFv (VH-4-VL) | CAGGTGCAATTGAAAGAAAGCGGCCCGGCCCTGGTGAAACCGACCCAAACCCTGACCCTGACCTGTACCTTTT<br>CCGGATTTAGCCTGTCTAATCGTGGTGGTGGTGTGGGTTGGATTCGCCAGCCGCCTGGGAAAGCCCTCGAGT<br>GGCTGGCTTGGATCGATTGGGATGATGATAAGTCTTATAGCACCAGCCTGAAAACGCGTCTGACCATTAGCA<br>AAGATACTTCGAAAAATCAGGTGGTGCTGACTATGACCAACATGGACCCGGTGGATACGGCCACCTATTATTG<br>CGCGCGTATGCATCTTCCTCTTGTTTTTGATTCTTGGGGCCAAGGCACCCTGGTGACGGTTAGCTCAGCTAGCA<br>CCAAGGGCCCCAGCGTGTTCCCCCTGGCCCCCAGCAGCAAGAGCACCAGCGGCGGCACAGCCGCCCTGGGCT<br>GCCTGGTGAAGGACTACTTCCCCGAGCCCGTGACCGTGTCCTGGAACAGCGGAGCCCTGACCTCCGGCGTGC<br>ACACCTTCCCCGCCGTGCTGCAGAGCAGCGGCCTGTACAGCCTGTCCAGCGTGGTGACAGTGCCCAGCAGCA<br>GCCTGGGCACCCAGACCTACATCTGCAACGTGAACCACAAGCCCAGCAACACCAAGGTGGACAAGAGAGTG<br>GAGCCCAAGAGCTGCGACAAGACCCACACCTGCCCCCCCTGCCCAGCCCCAGAGGCAGCGGGCGGACCCTCC<br>GTGTTCCTGTTCCCCCCCAAGCCCAAGGACACCCTGATGATCAGCAGGACCCCCGAGGTGACCTGCGTGGTG<br>GTGGACGTGAGCCACGAGGACCCAGAGGTGAAGTTCAACTGGTACGTGGACGGCGTGGAGGTGCACAACGC<br>CAAGACCAAGCCCAGAGAGGAGCAGTACAACAGCACCTACAGGGTGGTGTCCGTGCTGACCGTGCTGCACCA<br>GGACTGGCTGAACGGCAAGGAATACAAGTGCAAGGTCTCCAACAAGGCCCTGCCAGCCCCCATCGAAAAGAC<br>CATCAGCAAGGCCAAGGGCCAGCCACGGGAGCCCCAGGTGTACACCCTGCCCCCCTCCCGGGAGGAGATGA<br>CCAAGAACCAGGTGTCCCTGACCTGTCTGGTGAAGGGCTTCTACCCCAGCGACATCGCCGTGGAGTGGGAGA<br>GCAACGGCCAGCCCGAGAACAACTACAAGACCACCCCCCCAGTGCTGGACAGCGACGGCAGCTTCTTCCTGT<br>ACAGCAAGCTGACCGTGGACAAGTCCAGGTGGCAGCAGGGCAACGTGTTCAGCTGCAGCGTGATGCACGAA<br>GCGCTGCACAACCACTACACCCAGAAGAGCCTGAGCCTGTCCCCCGGCAAGGGCGGCTCCGGCGGAAGCCA<br>GGTTCAATTGGTTGAAAGCGGTGGTGGTCTGGTTCAGCCTGGTGGTAGCCTGCGTCTGAGCTGTGCAGCAAG<br>CGGTTTTACCTTTAGCGATTATGTGATTAATTGGGTTCGTCAGGCACCGGGTAAAGGTCTGGAATGGGTTAGC<br>GGTATTAGCTGGTCAGGTGTTAATACCCATTATGCAGATAGCGTGAAAGGTCGTTTTACCATTAGCCGTGATA<br>ATAGCAAAAATACCCTGTATCTGCAGATGAATAGCCTGCGTGCAGAAGATACCGCAGTTTATTATTGTGCACG<br>TCTGGGTGCAACCGCAAATAATATTCGCTATAAATTTATGGATGTGTGGGGTCAGGGTACACTAGTTACCGTT<br>AGCAGTGGTGGTGGTGGTAGCGGTGGTGGCGGATCTGGTGGCGGTGGTTCAGGTGGTGGTGGCAGTGATA<br>TCGAACTGACCCAGCCTCCGAGCGTTAGCGTTGCACCGGGTCAGACCGCACGTATTAGCTGTAGCGGTGATA<br>GTCTGCGTAATAAAGTTTATTGGTATCAGCAGAAACCGGGTCAGGCTCCGGTTCTGGTTATTTATAAAAATAA<br>TCGTCCGAGCGGTATTCCGGAACGTTTTAGCGGTAGCAATAGCGGTAATACCGCAACCCTGACCATTAGCGGC<br>ACCCAGGCAGAAGATGAAGCCGATTATTATTGTCAGAGCTATGATGGTCAGAAAAGCCTGGTTTTTGGTGGT<br>GGCACCAAGCTTACCGTTCTG |

TABLE 1-continued

Examples of LRP6 Antibodies of the Present Invention

| SEQ ID NUMBER | Ab region | Sequence |
|---|---|---|
| SEQ ID NO: 191 | VL MOR08168 wt | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVL |
| SEQ ID NO: 192 | DNA VL MOR08168 wt | GACATCGAGCTGACTCAGCCCCCTAGCGTGTCAGTGGCTCCTGGCCAGACCGCTAGAATTAGCTGTAGCGGC GATAGCCTGCGTAACAAGGTCTACTGGTATCAGCAGAAGCCCGGCCAGGCCCCTGTGCTGGTCATCTATAAG AACAATAGGCCTAGCGGCATCCCCGAGCGGTTTAGCGGCTCTAATAGCGGCAACACCGCTACCCTGACTATTA GCGGCACTCAGGCCGAGGACGAGGCCGACTACTACTGTCAGTCCTACGACGGCCAGAAGTCACTGGTCTTTG GCGGCGGAACTAAGCTGACCGTGCTG |
| SEQ ID NO: 193 | Light lambda MOR08168 wt | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |
| SEQ ID NO: 194 | DNA Light lambda MOR08168 wt | GACATCGAGCTGACTCAGCCCCCTAGCGTGTCAGTGGCTCCTGGCCAGACCGCTAGAATTAGCTGTAGCGGC GATAGCCTGCGTAACAAGGTCTACTGGTATCAGCAGAAGCCCGGCCAGGCCCCTGTGCTGGTCATCTATAAG AACAATAGGCCTAGCGGCATCCCCGAGCGGTTTAGCGGCTCTAATAGCGGCAACACCGCTACCCTGACTATTA GCGGCACTCAGGCCGAGGACGAGGCCGACTACTACTGTCAGTCCTACGACGGCCAGAAGTCACTGGTCTTTG GCGGCGGAACTAAGCTGACCGTGCTGGGACAGCCTAAGGCTGCCCCCAGCGTGACCCTGTTCCCCCCCAGCA GCGAGGAGCTGCAGGCCAACAAGGCCACCCTGGTGTGCCTGATCAGCGACTTCTACCCAGGCGCCGTGACCG TGGCCTGGAAGGCCGACAGCAGCCCCGTGAAGGCCGGCGTGGAGACCACCACCCCCAGCAAGCAGAGCAAC AACAAGTACGCCGCCAGCAGCTACCTGAGCCTGACCCCCGAGCAGTGGAAGAGCCACAGGTCCTACAGCTGC CAGGTGACCCACGAGGGCAGCACCGTGGAAAAGACCGTGGCCCCAACCGAGTGCAGC |
| SEQ ID NO: 195 | Heavy MOR08168IgG1LALA_6475scFv wt | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEALHNHYTQKSLSLSP GKGGSGGSDIVLTQSPATLSLSPGERATLSCRASQFIGSRYLAWYQQKPGQAPRLLIYGASNRATGVPARFSGSGSG TDFTLTISSLEPEDFATYYCQQYYDYPQTFGQGTKVEIKGGGGSGGGGSGGGGSGGGGSQVQLKESGPALVKPTQ TLTLTCTFSGFSLSNRGGGVGWIRQPPGKALEWLAWIDWDDDKSYSTSLKTRLTISKDTSKNQVVLTMTNMDPV DTATYYCARMHLPLVFDSWGQGTLVTVSS |
| SEQ ID NO: 196 | DNA Heavy MOR08168IgG1LALA_6475scFv wt | CAGGTGCAGCTGGTGGAATCAGGCGGAGGACTGGTCCAGCCTGGCGGATCACTTAGACTGAGCTGTGCCGC TAGTGGCTTCACCTTTAGCGACTATGTGATTAACTGGGTCCGACAGGCCCCTGGCAAGGGACTGGAATGGGT GTCAGGCATTAGTTGGAGCGGCGTGAACACTCACTACGCCGATAGCGTGAAGGGCCGGTTCACTATTAGCCG GGATAACTCTAAGAACACCCTGTACCTGCAGATGAATAGCCTGAGAGCCGAGGACACCGCCGTCTACTACTG CGCTAGACTGGGCGCTACCGCTAACAACATCCGCTATAAGTTCATGGACGTGTGGGGCCAGGGCACCCTGGT CACAGTGTCTTCAGCTAGCACTAAGGGCCCCTCAGTGTTCCCCCTGGCCCCTAGCTCTAAGTCTACTAGCGGTG GCACCGCCGCTCTGGGCTGCCTGGTCAAGGACTACTTCCCCGAGCCCGTGACCGTGTCTTGGAATAGCGGCG CTCTGACTAGCGGAGTGCACACCTTCCCCGCCGTGCTGCAGTCTAGCGGCCTGTATAGCCTGTCTAGCGTCGT GACCGTGCCTAGCTCTAGCCTGGGCACTCAGACCTATATCTGTAACGTGAACCACAAGCCTAGTAACACTAAG GTGGACAAGCGGGTGGAACCTAAGTCTTGCGATAAGACTCACACCTGTCCCCCCTGCCCTGCCCCAGAAGCTG CTGGCGGACCTAGCGTGTTCCTGTTCCCACCTAAGCCTAAAGACACCCTGATGATTAGTAGGACCCCCGAAGT GACCTGCGTGGTGGTGGACGTCAGCCACGAGGACCCTGAAGTGAAGTTCAATTGGTATGTGGACGGCGTGG AAGTGCACAACGCTAAGACTAAGCCTAGAGAGGAACAGTATAACTCCACCTATAGGGTGGTGTCAGTGCTGA |

TABLE 1-continued

| Examples of LRP6 Antibodies of the Present Invention | | |
|---|---|---|
| SEQ ID NUMBER | Ab region | Sequence |
| | | CCGTGCTGCACCAGGACTGGCTGAACGGCAAAGAGTATAAGTGTAAAGTCTCTAACAAGGCCCTGCCTGCCC CTATCGAAAAGACTATCTCTAAGGCTAAGGGCCAGCCTAGAGAACCCCAGGTCTACACCCTGCCCCCTAGTAG AGAAGAGATGACTAAGAATCAGGTGTCCCTGACCTGTCTGGTCAAGGGCTTCTACCCTAGCGATATCGCCGTG GAGTGGGAGTCTAACGGCCAGCCCGAGAACAACTATAAGACTACCCCCCCTGTGCTGGATAGCGACGGCTCT TTCTTCCTGTACTCTAAACTGACCGTGGACAAGTCTAGGTGGCAGCAGGGCAACGTGTTCAGCTGTAGCGTGA TGCACGAGGCCCTGCACAATCACTACACTCAGAAGTCACTGAGCCTGAGTCCCGGCAAGGGCGGCTCAGGCG GTAGCGATATCGTGCTGACTCAGTCACCCGCTACCCTGAGTCTGAGCCCTGGCGAGCGGGCTACACTGAGCT GTAGAGCTAGTCAGTTTATCGGCTCACGCTACCTGGCCTGGTATCAGCAGAAGCCCGGCCAGGCCCCTAGACT GCTGATCTACGGCGCTAGTAATAGAGCTACCGGCGTGCCCGCTAGGTTTAGCGGCTCAGGATCAGGCACCGA CTTTACCCTGACTATTAGTAGCCTGGAACCCGAGGACTTCGCTACCTACTACTGTCAGCAGTACTACGACTACC CTCAGACCTTCGGCCAGGGAACTAAGGTCGAGATTAAGGGCGGTGGCGGTAGCGGCGGAGGCGGATCAGG TGGTGGTGGTAGTGGCGGCGGAGGTAGTCAGGTCCAGCTGAAAGAGTCAGGCCCTGCCCTGGTCAAGCCTA CTCAGACCCTGACCCTGACCTGCACTTTTAGCGGCTTTAGCCTGAGTAATAGAGGCGGCGGAGTGGGCTGGA TTAGACAGCCTCCAGGCAAAGCCCTGGAGTGGCTGGCCTGGATCGACTGGGACGACGATAAGTCCTACTCCA CTAGCCTGAAAACTAGGCTGACAATCAGCAAGGACACTAGTAAAAACCAGGTGGTGCTGACTATGACTAATA TGGACCCCGTGGACACCGCTACCTATTATTGCGCTAGAATGCACCTCCCACTGGTGTTCGATAGCTGGGGTCA GGGAACTCTGGTCACAGTCAGTAGC |
| SEQ ID NO: 197 | VL MOR08168 DI | SYELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVL |
| SEQ ID NO: 198 | DNA VL MOR08168 DI | TCTTACGAGCTGACCCAGCCCCCTTCCGTGTCTGTGGCTCCTGGCCAGACCGCCAGAATCTCTTGCTCCGGCGA CTCCCTGCGGAACAAGGTGTACTGGTATCAGCAGAAGCCCGGCCAGGCCCCTGTGCTGGTCATCTACAAGAA CAACCGGCCCTCCGGCATCCCCGAGAGATTCTCTGGCTCCAACTCCGGCAACACCGCCACCCTGACAATCTCT GGCACACAGGCCGAGGACGAGGCCGACTACTACTGCCAGTCCTACGACGGCCAGAAATCACTGGTGTTCGGC GGAGGCACCAAGCTGACAGTGCTG |
| SEQ ID NO: 199 | Light lambda MOR08168 DI | SYELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |
| SEQ ID NO: 200 | DNA Light lambda MOR08168 DI | TCTTACGAGCTGACCCAGCCCCCTTCCGTGTCTGTGGCTCCTGGCCAGACCGCCAGAATCTCTTGCTCCGGCGA CTCCCTGCGGAACAAGGTGTACTGGTATCAGCAGAAGCCCGGCCAGGCCCCTGTGCTGGTCATCTACAAGAA CAACCGGCCCTCCGGCATCCCCGAGAGATTCTCTGGCTCCAACTCCGGCAACACCGCCACCCTGACAATCTCT GGCACACAGGCCGAGGACGAGGCCGACTACTACTGCCAGTCCTACGACGGCCAGAAATCACTGGTGTTCGGC GGAGGCACCAAGCTGACAGTGCTGGGACAGCCTAAGGCTGCCCCCAGCGTGACCCTGTTCCCCCCCAGCAGC GAGGAGCTGCAGGCCAACAAGGCCACCCTGGTGTGCCTGATCAGCGACTTCTACCCAGGCGCCGTGACCGTG GCCTGGAAGGCCGACAGCAGCCCCGTGAAGGCCGGCGTGGAGACCACCACCCCCAGCAAGCAGAGCAACAA CAAGTACGCCGCCAGCAGCTACCTGAGCCTGACCCCCGAGCAGTGGAAGAGCCACAGGTCCTACAGCTGCCA GGTGACCCACGAGGGCAGCACCGTGGAAAAGACCGTGGCCCCAACCGAGTGCAGC |
| SEQ ID NO: 201 | Heavy MOR08168IgG1LALA_6475scFv DI | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSVMHEALHNHYTQKSLSLSP GKGGSGGSDIVLTQSPATLSLSPGERATLSCRASQFIGSRYLAWYQQKPGQAPRLLIYGASNRATGVPARFSGSGSG |

TABLE 1-continued

| Examples of LRP6 Antibodies of the Present Invention | | |
|---|---|---|
| SEQ ID NUMBER | Ab region | Sequence |
| | | TDFTLTISSLEPEDFATYYCQQYYDYPQTFGQGTKVEIKGGGGSGGGGSGGGGSGGGGSQVQLKESGPALVKPTQ<br>TLTLTCTFSGFSLSNRGGGVGWIRQPPGKALEWLAWIDWDDDKSYSTSLKTRLTISKDTSKNQVVLTMTNMDPV<br>DTATYYCARMHLPLVFDSWGQGTLVTVSS |
| SEQ ID NO: 202 | DNA Heavy<br>MOR08168IgG1LALA_6475scFv<br><br>DI | CAGGTGCAGCTGGTGGAATCAGGCGGAGGACTGGTCCAGCCTGGCGGATCACTTAGACTGAGCTGTGCCGC<br>TAGTGGCTTCACCTTTAGCGACTATGTGATTAACTGGGTCCGACAGGCCCCTGGCAAGGGACTGGAATGGGT<br>GTCAGGCATTAGTTGGAGCGGCGTGAACACTCACTACGCCGATAGCGTGAAGGGCCGGTTCACTATTAGCCG<br>GGATAACTCTAAGAACACCCTGTACCTGCAGATGAATAGCCTGAGAGCCGAGGACACCGCCGTCTACTACTG<br>CGCTAGACTGGGCGCTACCGCTAACAACATCCGCTATAAGTTCATGGACGTGTGGGGCCAGGGCACCCTGGT<br>CACAGTGTCTTCAGCTAGCACTAAGGGCCCCTCAGTGTTCCCCCTGGCCCCTAGCTCTAAGTCTACTAGCGGTG<br>GCACCGCCGCTCTGGGCTGCCTGGTCAAGGACTACTTCCCCGAGCCCGTGACCGTGTCTTGGAATAGCGGCG<br>CTCTGACTAGCGGAGTGCACACCTTCCCCGCCGTGCTGCAGTCTAGCGGCCTGTATAGCCTGTCTAGCGTCGT<br>GACCGTGCCTAGCTCTAGCCTGGGCACTCAGACCTATATCTGTAACGTGAACCACAAGCCTAGTAACACTAAG<br>GTGGACAAGCGGGTGGAACCTAAGTCTTGCGATAAGACTCACACCTGTCCCCCCTGCCCTGCCCCAGAAGCTG<br>CTGGCGGACCTAGCGTGTTCCTGTTCCCACCTAAGCCTAAAGACACCCTGATGATTAGTAGGACCCCCGAAGT<br>GACCTGCGTGGTGGTGGACGTCAGCCACGAGGACCCTGAAGTGAAGTTCAATTGGTATGTGGACGGCGTGG<br>AAGTGCACAACGCTAAGACTAAGCCTAGAGAGGAACAGTATAACTCCACCTATAGGGTGGTGTCAGTGCTGA<br>CCGTGCTGCACCAGGACTGGCTGAACGGCAAAGAGTATAAGTGTAAAGTCTCTAACAAGGCCCTGCCTGCCC<br>CTATCGAAAAGACTATCTCTAAGGCTAAGGGCCAGCCTAGAGAACCCCAGGTCTACACCCTGCCCCCTAGTAG<br>AGAAGAGATGACTAAGAATCAGGTGTCCCTGACCTGTCTGGTCAAGGGCTTCTACCCTAGCGATATCGCCGTG<br>GAGTGGGAGTCTAACGGCCAGCCCGAGAACAACTATAAGACTACCCCCCCTGTGCTGGATAGCGACGGCTCT<br>TTCTTCCTGTACTCTAAACTGACCGTGGACAAGTCTAGGTGGCAGCAGGGCAACGTGTTCAGCTGTAGCGTGA<br>TGCACGAGGCCCTGCACAATCACTACACTCAGAAGTCACTGAGCCTGAGTCCCGGCAAGGGCGGCTCAGGCG<br>GTAGCGATATCGTGCTGACTCAGTCACCCGCTACCCTGAGTCTGAGCCCTGGCGAGCGGGCTACACTGAGCT<br>GTAGAGCTAGTCAGTTTATCGGCTCACGCTACCTGGCCTGGTATCAGCAGAAGCCCGGCCAGGCCCCTAGACT<br>GCTGATCTACGGCGCTAGTAATAGAGCTACCGGCGTGCCCGCTAGGTTTAGCGGCTCAGGATCAGGCACCGA<br>CTTTACCCTGACTATTAGTAGCCTGGAACCCGAGGACTTCGCTACCTACTACTGTCAGCAGTACTACGACTACC<br>CTCAGACCTTCGGCCAGGGAACTAAGGTCGAGATTAAGGGCGGTGGCGGTAGCGGCGGAGGCGGATCAGG<br>TGGTGGTGGTAGTGGCGGCGGAGGTAGTCAGGTCCAGCTGAAAGAGTCAGGCCCTGCCCTGGTCAAGCCTA<br>CTCAGACCCTGACCCTGACCTGCACTTTTAGCGGCTTTAGCCTGAGTAATAGAGGCGGCGGAGTGGGCTGGA<br>TTAGACAGCCTCCAGGCAAAGCCCTGGAGTGGCTGGCCTGGATCGACTGGGACGACGATAAGTCCTACTCCA<br>CTAGCCTGAAAACTAGGCTGACAATCAGCAAGGACACTAGTAAAAACCAGGTGGTGCTGACTATGACTAATA<br>TGGACCCCGTGGACACCGCTACCTATTATTGCGCTAGAATGCACCTCCCACTGGTGTTCGATAGCTGGGGTCA<br>GGGAACTCTGGTCACAGTCAGTAGC |
| SEQ ID NO: 203 | VL MOR08168<br>GL | SYELTQPLSVSVALGQTARITCSGDSLRNKVYWYQQKPGQAPVLVIYKNNRPSGIPERFSGSNSGNTATLTISRAQA<br>GDEADYYCQSYDGQKSLVFGGGTKLTVL |
| SEQ ID NO: 204 | DNA VL<br>MOR08168 GL | AGCTACGAGCTGACTCAGCCCCTGAGCGTGTCAGTGGCTCTGGGCCAGACCGCTAGAATCACCTGTAGCGGC<br>GATAGCCTGAGAAACAAGGTCTACTGGTATCAGCAGAAGCCCGGCCAGGCCCCTGTGCTGGTCATCTATAAG<br>AACAATAGGCCTAGCGGCATCCCCGAGCGGTTTAGCGGCTCTAATAGCGGCAACACCGCTACCCTGACTATTA<br>GTAGGGCTCAGGCCGGCGACGAGGCCGACTACTACTGTCAGTCCTACGACGGCCAGAAGTCACTGGTCTTTG<br>GCGGCGGAACTAAGCTGACCGTGCTG |

TABLE 1-continued

Examples of LRP6 Antibodies of the Present Invention

| SEQ ID NUMBER | Ab region | Sequence |
|---|---|---|
| SEQ ID NO: 205 | Light lambda MOR08168 GL | SYELTQPLSVSVALGQTARITCSGDSLRNKVYWYQQKPGQAPVLVIYKNNRPSGIPERFSGSNSGNTATLTISRAQA<br>GDEADYYCQSYDGQKSLVFGGGTKLTVLGQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTVEKTVAPTECS |
| SEQ ID NO: 206 | DNA Light lambda MOR08168 GL | AGCTACGAGCTGACTCAGCCCCTGAGCGTGTCAGTGGCTCTGGGCCAGACCGCTAGAATCACCTGTAGCGGC<br>GATAGCCTGAGAAACAAGGTCTACTGGTATCAGCAGAAGCCCGGCCAGGCCCCTGTGCTGGTCATCTATAAG<br>AACAATAGGCCTAGCGGCATCCCCGAGCGGTTTAGCGGCTCTAATAGCGGCAACACCGCTACCCTGACTATTA<br>GTAGGGCTCAGGCCGGCGACGAGGCCGACTACTACTGTCAGTCCTACGACGGCCAGAAGTCACTGGTCTTTG<br>GCGGCGGAACTAAGCTGACCGTGCTGGGACAGCCTAAGGCTGCCCCCAGCGTGACCCTGTTCCCCCCCAGCA<br>GCGAGGAGCTGCAGGCCAACAAGGCCACCCTGGTGTGCCTGATCAGCGACTTCTACCCAGGCGCCGTGACCG<br>TGGCCTGGAAGGCCGACAGCAGCCCCGTGAAGGCCGGCGTGGAGACCACCACCCCCAGCAAGCAGAGCAAC<br>AACAAGTACGCCGCCAGCAGCTACCTGAGCCTGACCCCCGAGCAGTGGAAGAGCCACAGGTCCTACAGCTGC<br>CAGGTGACCCACGAGGGCAGCACCGTGGAAAAGACCGTGGCCCCAACCGAGTGCAGC |
| SEQ ID NO: 207 | Heavy MOR08168IgG1LALA_6475scFv GL | EVQLLESGGGLVQPGGSLRLSCAASGFTFSDYVINWVRQAPGKGLEWVSGISWSGVNTHYADSVKGRFTISRDNS<br>KNTLYLQMNSLRAEDTAVYYCARLGATANNIRYKFMDVWGQGTLVTVSSASTKGPSVFPLAPSSKSTSGGTAALG<br>CLVKDYFPEPVTVSWNSGALTSGVHTFPAVLQSSGLYSLSSVVTVPSSSLGTQTYICNVNHKPSNTKVDKRVEPKSC<br>DKTHTCPPCPAPEAAGGPSVFLFPPKPKDTLMISRTPEVTCVVVDVSHEDPEVKFNWYVDGVEVHNAKTKPREEQ<br>YNSTYRVVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGSGGSDIVLTQSPATLSLSPGERATLSCRASQFIGSRYLAWYQQKPGQAPRLLIYGASNRATGVPARFSGSGSGTD<br>FTLTISSLEPEDFATYYCQQYYDYPQTFGQGTKVEIKGGGGSGGGGSGGGGSGGGGSQVQLKESGPALVKPTQTL<br>TLTCTFSGFSLSNRGGGVGWIRQPPGKALEWLAWIDWDDDKSYSTSLKTRLTISKDTSKNQVVLTMTNMDPVDT<br>ATYYCARMHLPLVFDSWGQGTLVTVSS |
| SEQ ID NO: 208 | DNA Heavy MOR08168IgG1LALA_6475scFv GL | GAGGTGCAGCTGCTGGAATCAGGCGGAGGACTGGTGCAGCCTGGCGGATCACTGAGACTGAGCTGTGCCGC<br>TAGTGGCTTCACCTTTAGCGACTATGTGATTAACTGGGTCCGACAGGCCCCTGGCAAGGGACTGGAATGGGT<br>GTCAGGCATTAGTTGGAGCGGCGTGAACACTCACTACGCCGATAGCGTGAAGGGCCGGTTCACTATTAGCCG<br>GGATAACTCTAAGAACACCCTGTACCTGCAGATGAATAGCCTGAGAGCCGAGGACACCGCCGTCTACTACTG<br>CGCTAGACTGGGCGCTACCGCTAACAACATCCGCTATAAGTTCATGGACGTGTGGGGCCAGGGCACCCTGGT<br>CACAGTGTCTTCAGCTAGCACTAAGGGCCCCTCAGTGTTCCCCCTGGCCCCTAGCTCTAAGTCTACTAGCGGTG<br>GCACCGCCGCTCTGGGCTGCCTGGTCAAGGACTACTTCCCCGAGCCCGTGACCGTGTCTTGGAATAGCGGCG<br>CTCTGACTAGCGGAGTGCACACCTTCCCCGCCGTGCTGCAGTCTAGCGGCCTGTATAGCCTGTCTAGCGTCGT<br>GACCGTGCCTAGCTCTAGCCTGGGCACTCAGACCTATATCTGTAACGTGAACCACAAGCCTAGTAACACTAAG<br>GTGGACAAGCGGGTGGAACCTAAGTCTTGCGATAAGACTCACACCTGTCCCCCCTGCCCTGCCCCAGAAGCTG<br>CTGGCGGACCTAGCGTGTTCCTGTTCCCACCTAAGCCTAAAGACACCCTGATGATTAGTAGGACCCCCGAAGT<br>GACCTGCGTGGTGGTGGACGTCAGCCACGAGGACCCTGAAGTGAAGTTCAATTGGTATGTGGACGGCGTGG<br>AAGTGCACAACGCTAAGACTAAGCCTAGAGAGGAACAGTATAACTCCACCTATAGGGTGGTGTCAGTGCTGA<br>CCGTGCTGCACCAGGACTGGCTGAACGGCAAAGAGTATAAGTGTAAAGTCTCTAACAAGGCCCTGCCTGCCC<br>CTATCGAAAAGACTATCTCTAAGGCTAAGGGCCAGCCTAGAGAACCCCAGGTCTACACCCTGCCCCCTAGTAG |

TABLE 1-continued

| Examples of LRP6 Antibodies of the Present Invention | | |
|---|---|---|
| SEQ ID NUMBER | Ab region | Sequence |
| | | AGAAGAGATGACTAAGAATCAGGTGTCCCTGACCTGTCTGGTCAAGGGCTTCTACCCTAGCGATATCGCCGTG<br>GAGTGGGAGTCTAACGGCCAGCCCGAGAACAACTATAAGACTACCCCCCCTGTGCTGGATAGCGACGGCTCT<br>TTCTTCCTGTACTCTAAACTGACCGTGGACAAGTCTAGGTGGCAGCAGGGCAACGTGTTCAGCTGTAGCGTGA<br>TGCACGAGGCCCTGCACAATCACTACACTCAGAAGTCACTGAGCCTGAGTCCCGGCAAGGGCGGCTCAGGCG<br>GTAGCGATATCGTGCTGACTCAGTCACCCGCTACCCTGAGTCTGAGCCCTGGCGAGCGGGCTACACTGAGCT<br>GTAGAGCTAGTCAGTTTATCGGCTCACGCTACCTGGCCTGGTATCAGCAGAAGCCCGGCCAGGCCCCTAGACT<br>GCTGATCTACGGCGCTAGTAATAGAGCTACCGGCGTGCCCGCTAGGTTTAGCGGCTCAGGATCAGGCACCGA<br>CTTTACCCTGACTATTAGTAGCCTGGAACCCGAGGACTTCGCTACCTACTACTGTCAGCAGTACTACGACTACC<br>CTCAGACCTTCGGCCAGGGAACTAAGGTCGAGATTAAGGGCGGTGGCGGTAGCGGCGGAGGCGGATCAGG<br>TGGTGGTGGTAGTGGCGGCGGAGGTAGTCAGGTCCAGCTGAAAGAGTCAGGCCCTGCCCTGGTCAAGCCTA<br>CTCAGACCCTGACCCTGACCTGCACTTTTAGCGGCTTTAGCCTGAGTAATAGAGGCGGCGGAGTGGGCTGGA<br>TTAGACAGCCTCCAGGCAAAGCCCTGGAGTGGCTGGCCTGGATCGACTGGGACGACGATAAGTCCTACTCCA<br>CTAGCCTGAAAACTAGGCTGACAATCAGCAAGGACACTAGTAAAAACCAGGTGGTGCTGACTATGACTAATA<br>TGGACCCCGTGGACACCGCTACCTATTATTGCGCTAGAATGCACCTCCCACTGGTGTTCGATAGCTGGGGTCA<br>GGGAACTCTGGTCACAGTCAGTAGC |

Antibodies that specifically bind to a LRP6 protein (e.g., human and/or cynomologus LRP6) are shown in Table 1 Supra and comprise a VH domain having an amino acid sequence of SEQ ID NOs: 14, 34, 36, 44, 60 and 62; and a VL domain having an amino acid sequence of SEQ ID NOs: 13, 33, 35, 43, 59, and 61. Additional antibodies that specifically bind a LRP6 protein (e.g., human and/or cynomologus LRP6) comprise a VH domain having an amino acid sequence of SEQ ID NOs: 82, 89, 106, 108, 128, 130, and 138; and a VL domain having an amino acid sequence of SEQ ID NOs: 81, 90, 105, 107, 127, and 129.

Other antibodies include amino acids that have been mutated, yet have at least 60%, 70%, 80%, 90%, 95% or 98% identity in the CDR regions with the CDR regions depicted in the sequences described in Table 1. In some embodiments, it includes mutant amino acid sequences wherein no more than 1, 2, 3, 4 or 5 amino acids have been mutated in the CDR regions when compared with the CDR regions depicted in the sequence described in Table 1, while still maintaining their specifity for the original antibody's epitope.

The present invention also provides nucleic acid sequences that encode VH, VL, the full length heavy chain, and the full length light chain of the antibodies that specifically bind to a LRP6 protein (e.g., human and/or cynomologus LRP6). Such nucleic acid sequences can be optimized for expression in mammalian cells (for example, Table 1 for MOR08168, MOR08545, and MOR06706 for β-propeller 1 antibodies and MOR06475, MOR08193, and MOR08473 for β-propeller 3 antibodies). Such nucleic acid sequences can further be used to produce LRP6 constructs.

The LRP6 antibodies bind to distinct LRP6 β-propeller regions. Propeller 1 antibodies bind to the β-propeller 1 domain and block Propeller 1-dependent Wnts such as Wnt1, Wnt2, Wnt6, Wnt7A, Wnt7B, Wnt9, Wnt10A, Wnt10B. Propeller 3 antibodies bind to the β-propeller 3 domain and block Propeller 3-dependent Wnts such as Wnt3a and Wnt3.

Other antibodies include those where the amino acids or nucleic acids encoding the amino acids have been mutated, yet have at least 60%, 70%, 80%, 90%, 95% or 98% identity to the sequences described in Table 1. In some embodiments, it include mutant amino acid sequences wherein no more than 1, 2, 3, 4 or 5 amino acids have been mutated in the variable regions when compared with the variable regions depicted in the sequence described in Table 1, while retaining substantially the same therapeutic activity.

Each of these antibodies can bind to LRP6, the VH, VL, full length light chain, and full length heavy chain sequences (amino acid sequences and the nucleotide sequences encoding the amino acid sequences) can be "mixed and matched" to create other LRP6 antibodies. Such "mixed and matched" LRP6 antibodies can be tested using the binding assays known in the art (e.g., ELISAs, and other assays described in the Example section). With these mixed and matched antibodies, a VH sequence from a particular VH/VL pairing should be replaced with a structurally similar VH sequence. Likewise a full length heavy chain sequence from a particular full length heavy chain/full length light chain pairing should be replaced with a structurally similar full length heavy chain sequence. Likewise, a VL sequence from a particular VH/VL pairing should be replaced with a structurally similar VL sequence. Likewise a full length light chain sequence from a particular full length heavy chain/full length light chain pairing should be replaced with a structurally similar full length light chain sequence. Accordingly, in one aspect, the invention provides an isolated monoclonal antibody or fragment thereof having: a heavy chain variable region comprising an amino acid sequence selected from the group consisting of SEQ ID NOs: 14, 34, 36, 44, 60, and 62; and a light chain variable region comprising an amino acid sequence selected from the group consisting of SEQ ID NOs: 13, 33, 35, 43, 59 and 61; a heavy chain selected from the group consisting of SEQ ID NOs: 82, 106, 108, 128, 130 and 138; and a light chain variable region comprising an amino acid sequence selected from the group consisting of SEQ ID NOs: 81, and 90, 105, 107, 127, 129, and 137; wherein the antibody specifically binds to LRP6 (e.g., human and/or cynomologus LRP6).

LRP6 antibodies that bind to the β propeller 1 domain of LRP6 that comprise the heavy chain and light chain CDR1s, CDR2s and CDR3s (or combinations thereof) are described in Table 1. The amino acid sequences of the VH CDR1s of the antibodies are shown in SEQ ID NOs: 1, 21, and 47. The amino acid sequences of the VH CDR2s of the antibodies are shown in SEQ ID NOs: 2, 22, and 48. The amino acid sequences of the VH CDR3s of the antibodies are shown in SEQ ID NOs: 3, 23, and 49. The amino acid sequences of the VL CDR1s of the antibodies are shown in SEQ ID NOs: 4, 24, and 50. The amino acid sequences of the VL CDR2s of the antibodies are shown in SEQ ID NOs: 5, 25, and 51. The amino acid sequences of the VL CDR3s of the antibodies are shown in SEQ ID NOs: 6, 26, and 52. The CDR regions are delineated using the Kabat system (Kabat et al., (1991) Sequences of Proteins of Immunological Interest, Fifth Edition, U.S. Department of Health and Human Services, NIH Publication No. 91-3242; Chothia et al., (1987) J. Mol. Biol. 196: 901-917; Chothia et al., (1989) Nature 342: 877-883; and Al-Lazikani et al., (1997) J. Mol. Biol. 273, 927-948).

LRP6 antibodies that bind to the β propeller 3 domain of LRP6 that comprise the heavy chain and light chain CDR1s, CDR2s and CDR3s (or combinations thereof) are described in Table 1. The amino acid sequences of the VH CDR1s of the antibodies are shown in SEQ ID NOs: 69, 93, and 115. The amino acid sequences of the VH CDR2s of the antibodies are shown in SEQ ID NOs: 70, 94, and 116. The amino acid sequences of the VH CDR3s of the antibodies are shown in SEQ ID NOs: 71, 95, and 117. The amino acid sequences of the VL CDR1s of the antibodies are shown in SEQ ID NOs: 72, 96, and 118. The amino acid sequences of the VL CDR2s of the antibodies are shown in SEQ ID NOs: 73, 97, and 119. The amino acid sequences of the VL CDR3s of the antibodies are shown in SEQ ID NOs: 74, 98, and 120. Given that each of these antibodies can bind to LRP6 and that antigen-binding specificity is provided primarily by the CDR1, 2 and 3 regions, the VH CDR1, 2 and 3 sequences and VL CDR1, 2 and 3 sequences can be "mixed and matched" (i.e., CDRs from different antibodies can be mixed and match, although each antibody must contain a VH CDR1, 2 and 3 and a VL CDR1, 2 and 3 to create other LRP6 binding molecules. Such "mixed and matched" LRP6 antibodies can be tested using the binding assays known in the art and those described in the Examples (e.g., ELISAs). When VH CDR sequences are mixed and matched, the CDR1, CDR2 and/or CDR3 sequence from a particular VH sequence should be replaced with a structurally similar CDR sequence(s). Likewise, when VL CDR sequences are mixed and matched, the CDR1, CDR2 and/or CDR3 sequence from a particular VL sequence should be replaced with a structurally similar CDR sequence(s). It will be readily apparent to the ordinarily skilled artisan that novel VH and VL sequences can be created by substituting one or more VH and/or VL CDR region sequences with structurally similar sequences from the CDR sequences shown herein for monoclonal antibodies of the present invention.

Accordingly, the present invention provides an isolated LRP6 β-propeller 1 monoclonal antibody or fragment thereof comprising a heavy chain variable region CDR1 comprising an amino acid sequence selected from the group consisting of SEQ ID NOs: 1, 21, and 47; a heavy chain variable region CDR2 comprising an amino acid sequence selected from the group consisting of SEQ ID NOs: 2, 22, and 48; a heavy chain variable region CDR3 comprising an amino acid sequence selected from the group consisting of SEQ ID NOs: 3, 23, and 49; a light chain variable region CDR1 comprising an amino acid sequence selected from the group consisting of SEQ ID NOs: 4, 24, and 50; a light chain variable region CDR2 comprising an amino acid sequence selected from the group consisting of SEQ ID NOs: 5, 25, and 51; and a light chain variable region CDR3 comprising an amino acid sequence selected from the group consisting of SEQ ID NOs: 6, 26, and 52; wherein the antibody binds LRP6.

Accordingly, the present invention provides an isolated LRP6 β-propeller 3 monoclonal antibody or fragment thereof comprising a heavy chain variable region CDR1 comprising an amino acid sequence selected from the group consisting of SEQ ID NOs: 69, 93, and 115; a heavy chain variable region CDR2 comprising an amino acid sequence selected from the group consisting of SEQ ID NOs: 70, 94, and 116; a heavy chain variable region CDR3 comprising an amino acid sequence selected from the group consisting of SEQ ID NOs: 71, 95, and 117; a light chain variable region CDR1 comprising an amino acid sequence selected from the group consisting of SEQ ID NOs: 72, 96, and 118; a light chain variable region CDR2 comprising an amino acid sequence selected from the group consisting of SEQ ID NOs: 73, 97, and 119; and a light chain variable region CDR3 comprising an amino acid sequence selected from the group consisting of SEQ ID NOs: 74, 98, and 120; wherein the antibody binds LRP6.

In a specific embodiment, an antibody that binds to LRP6 comprises a heavy chain variable region CDR1 of SEQ ID NO: 1; a heavy chain variable region CDR2 of SEQ ID NO: 2; a heavy chain variable region CDR3 of SEQ ID NO: 3; a light chain variable region CDR1 of SEQ ID NO: 4; a light chain variable region CDR2 of SEQ ID NO: 5; and a light chain variable region CDR3 of SEQ ID NO: 6.

In a specific embodiment, an antibody that binds to LRP6 comprises a heavy chain variable region CDR1 of SEQ ID NO: 21; a heavy chain variable region CDR2 of SEQ ID NO: 22; a heavy chain variable region CDR3 of SEQ ID NO: 23; a light chain variable region CDR1 of SEQ ID NO: 24; a light chain variable region CDR2 of SEQ ID NO: 25; and a light chain variable region CDR3 of SEQ ID NO: 26.

In a specific embodiment, an antibody that binds to LRP6 comprises a heavy chain variable region CDR1 of SEQ ID NO: 47; a heavy chain variable region CDR2 of SEQ ID NO: 48; a heavy chain variable region CDR3 of SEQ ID NO: 49; a light chain variable region CDR1 of SEQ ID NO: 50; a light chain variable region CDR2 of SEQ ID NO: 51; and a light chain variable region CDR3 of SEQ ID NO: 52.

In a specific embodiment, an antibody that binds to LRP6 comprises a heavy chain variable region CDR1 of SEQ ID NO: 69; a heavy chain variable region CDR2 of SEQ ID NO: 70; a heavy chain variable region CDR3 of SEQ ID NO: 71; a light chain variable region CDR1 of SEQ ID NO: 72; a light chain variable region CDR2 of SEQ ID NO: 73; and a light chain variable region CDR3 of SEQ ID NO: 74.

In a specific embodiment, an antibody that binds to LRP6 comprises a heavy chain variable region CDR1 of SEQ ID NO: 93; a heavy chain variable region CDR2 of SEQ ID NO: 94; a heavy chain variable region CDR3 of SEQ ID NO: 95; a light chain variable region CDR1 of SEQ ID NO: 96; a light chain variable region CDR2 of SEQ ID NO: 97; and a light chain variable region CDR3 of SEQ ID NO: 98.

In a specific embodiment, an antibody that binds to LRP6 comprises a heavy chain variable region CDR1 of SEQ ID NO: 115; a heavy chain variable region CDR2 of SEQ ID NO: 116; a heavy chain variable region CDR3 of SEQ ID NO: 117; a light chain variable region CDR1 of SEQ ID NO: 118; a light chain variable region CDR2 of SEQ ID NO: 119; and a light chain variable region CDR3 of SEQ ID NO: 120.

In a specific embodiment, an antibody that binds to LRP6 comprises a VH of SEQ ID NO: 14 and VL of SEQ ID NO: 13. In a specific embodiment, an antibody that binds to LRP6 comprises a VH of SEQ ID NO: 34 and VL of SEQ ID NO: 33. In a specific embodiment, an antibody that binds to LRP6 comprises a VH of SEQ ID NO: 35 and VL of SEQ ID NO: 36. In a specific embodiment, an antibody that binds to LRP6 comprises a VH of SEQ ID NO; 43 and VL of SEQ ID NO: 44. In a specific embodiment, an antibody that binds to LRP6 comprises a VH of SEQ ID NO: 60 and VL of SEQ ID NO: 59. In a specific embodiment, an antibody that binds to LRP6 comprises a VH of SEQ ID NO; 62 and VL of SEQ ID NO: 61. In a specific embodiment, an antibody that binds to LRP6 comprises a SEQ ID NO: 82 and VL of SEQ ID NO: 81. In a specific embodiment, an antibody that binds to LRP6 comprises a VH of SEQ ID NO; 90 and VL of SEQ ID NO: 89. In a specific embodiment, an antibody that binds to LRP6 comprises a VH of SEQ ID NO: 106 and VL of SEQ ID NO: 105. In a specific embodiment, an antibody that binds to LRP6 comprises a VH of SEQ ID NO: 108 and VL of SEQ ID NO: 107. In a specific embodiment, an antibody that binds to LRP6 comprises a VH of SEQ ID NO: 128 and VL of SEQ ID NO: 127. In a specific embodiment, an antibody that binds to LRP6 comprises a VH of SEQ ID NO: 130 and VL of SEQ ID NO: 129. In a specific embodiment, an antibody that binds to LRP6 comprises a VH of SEQ ID NO: 138 and VL of SEQ ID NO: 137.

In one embodiment, the LRP6 antibodies are antagonist antibodies. In one embodiment, the LRP6 antibodies are agonist antibodies. In certain embodiments, an antibody that binds to LRP6 is an antibody that is described in Table 1.

As used herein, a human antibody comprises heavy or light chain variable regions or full length heavy or light chains that are "the product of" or "derived from" a particular germline sequence if the variable regions or full length chains of the antibody are obtained from a system that uses human germline immunoglobulin genes. Such systems include immunizing a transgenic mouse carrying human immunoglobulin genes with the antigen of interest or screening a human immunoglobulin gene library displayed on phage with the antigen of interest. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally occurring somatic mutations or intentional introduction of site-directed mutations. However, in the VH or VL framework regions, a selected human antibody typically is at least 90% identical in amino acids sequence to an amino acid sequence encoded by a human germline immunoglobulin gene and contains amino acid residues that identify the human antibody as being human when compared to the germline immunoglobulin amino acid sequences of other species (e.g., murine germline sequences). In certain cases, a human antibody may be at least 60%, 70%, 80%, 90%, or at least 95%, or even at least 96%, 97%, 98%, or 99% identical in amino acid sequence to the amino acid sequence encoded by the germline immunoglobulin gene. Typically, a recombinant human antibody will display no more than 10 amino acid differences from the amino acid sequence encoded by the human germline immunoglobulin gene in the VH or VL framework regions. In certain cases, the human antibody may display no more than 5, or even no more than 4, 3, 2, or 1 amino acid difference from the amino acid sequence encoded by the germline immunoglobulin gene.

Homologous Antibodies

Also included within the scope of invention are antibody or fragment thereof comprising amino acid sequences that are homologous to the sequences described in Table 1, where the homologous antibody binds to a LRP6 protein (e.g., human and/or cynomologus LRP6), and retains the desired functional properties of those antibodies described in Table 1.

For example, an isolated monoclonal antibody (or fragment thereof) comprising a heavy chain variable region and a light chain variable region, wherein the heavy chain variable region comprises an amino acid sequence that is at least 80%, at least 90%, or at least 95% or at least 98% identical to an amino acid sequence selected from the group consisting of SEQ ID NOs: 14, 34, 36, 44, 60, and 62; the light chain variable region comprises an amino acid sequence that is at least 80%, at least 90%, at least 95%, or at least 98% identical to an amino acid sequence selected from the group consisting of SEQ ID NOs: 13, 33, 37, 43 59, and 61; wherein the antibody binds to β-propeller 1 of LRP6 (e.g., human and/or cynomologus LRP6), and inhibits the signaling activity of β-propeller 1 dependent Wnt proteins. The signaling activity can be measured in Wnt reporter gene assay or other measure of Wnt directed signaling (e.g., LRP6 phosphorylation, β-catenin stabilization and nuclear translocation, cellular proliferation/survival) as described herein. In a specific example, such antibodies have an $EC_{50}$ value in a Wnt1 assay of less than 10 nM when using conditioned medium or using transfected cells.

Another example, is an isolated monoclonal antibody (or fragment thereof) comprising a heavy chain variable region and a light chain variable region, wherein the heavy chain variable region comprises an amino acid sequence that is at least 80%, at least 90%, at least 95%, or at least 98%, or at least 98% identical to an amino acid sequence selected from the group consisting of SEQ ID NOs: 82, 89, 106, 108, 128, 130, and 138; the light chain variable region comprises an amino acid sequence that is at least 80%, at least 90%, at least 95%, or at least 98% identical to an amino acid sequence selected from the group consisting of SEQ ID NOs: 81, 90, 105, 107, 127, 129, and 137; wherein the antibody binds to β-propeller 3 of LRP6 (e.g., human and/or cynomologus LRP6), and inhibits the signaling activity of β-propeller 3 dependent Wnt proteins. The signaling activity can be measured in Wnt reporter gene assay or other measure of Wnt directed signaling (e.g., LRP6 phosphorylation, β-catenin stabilization and nuclear translocation, cellular proliferation/survival) as described herein. In a specific example, such antibodies have an $EC_{50}$ value in a Wnt3a assay of less than 10 nM when using conditioned medium or using transfected cells.

In other embodiments, the VH and/or VL amino acid sequences may be 50%, 60%, 70%, 80%, 90%, 95%, 96%, 97%, 98% or 99% identical to the sequences set forth in Table 1. In other embodiments, the VH and/or VL amino acid sequences may be identical except an amino acid substitution in no more than 1, 2, 3, 4 or 5 amino acid position. An antibody having VH and VL regions having high (i.e., 80% or greater) identity to the VH and VL regions of those Propeller 1 antibodies described in Table 1 can be obtained by mutagenesis (e.g., site-directed or PCR-mediated mutagenesis) of nucleic acid molecules encoding SEQ ID NOs: 14, 34, 60, 13, 33, and 59 respectively, followed by testing of the encoded altered antibody for retained function using the functional assays described herein.

An antibody having VH and VL regions having high (i.e., 80% or greater) identity to the VH and VL regions of those Propeller 3 antibodies described in Table 1 can be obtained by mutagenesis (e.g., site-directed or PCR-mediated mutagenesis) of nucleic acid molecules encoding SEQ ID NOs: 82, 106, 128, 81, 105, and 127 respectively, followed by testing of the encoded altered antibody for retained function using the functional assays described herein.

In other embodiments, the variable regions of heavy chain and/or light chain nucleotide sequences may be 60%, 70%, 80%, 90%, 95%, 96%, 97%, 98% or 99% identical to the sequences set forth above. These homologous antibodies or fragments thereof can be used to generate the LRP6 constructs, Antibodies with Conservative Modifications Also included within the scope are antibodies with conservative modifications. The antibody has a heavy chain variable region comprising CDR1, CDR2, and CDR3 sequences and a light chain variable region comprising CDR1, CDR2, and CDR3 sequences, wherein one or more of these CDR sequences have specified amino acid sequences or conservative modifications thereof, wherein the antibodies with conservative modifications or fragments thereof specifically bind to LRP6, and inhibits LRP6 activity by inhibiting a Wnt signaling pathway, which can be measured in Wnt reporter gene assay or other measure of Wnt directed signaling (e.g., LRP6 phosphorylation, β-catenin stabilization and nuclear translocation, cellular proliferation/survival) as described herein. These antibodies or fragments thereof with conservative modifications can be used to generate the LRP6 constructs of the invention.

Antibodies that Bind to the Same Epitope

Also within the scope are antibodies that bind to the same epitope as do the LRP6 antibodies described in Table 1. Additional antibodies can therefore be identified based on their ability to cross-compete (e.g., to competitively inhibit the binding of, in a statistically significant manner) with other antibodies in LRP6 binding assays disclosed herein. The ability of a test antibody to inhibit the binding of antibodies of the present invention to a LRP6 protein (e.g., human and/or cynomologus LRP6) demonstrates that the test antibody can compete with that antibody for binding to LRP6; such an antibody may, according to non-limiting theory, bind to the same or a related (e.g., a structurally similar or spatially proximal) epitope on the LRP6 protein as the antibody with which it competes. In an embodiment, the antibody that binds to the same epitope on LRP6 as the antibodies of the present invention is a human monoclonal antibody. Such human monoclonal antibodies can be prepared and isolated as described herein. These antibodies or fragments thereof that bind to the same epitope can be used to generate the LRP6 constructs of the invention.

2. Antibody Fragments

In one embodiment, the LRP6 constructs are produced by using at least one antibody fragment linked to an half-life extender such that the LRP6 construct binds to LRP6 and inhibits Wnt signaling without potentiation of the Wnt signal and displays an increased half-life in vitro and in vivo. The antibody fragments of an antibody should retain the ability to bind with specificity to a target antigen. Antibody fragments include separate variable heavy chains, variable light chains, Fab, Fab', $F(ab')_2$, Fabc, and scFab. Fragments can be produced by enzymatic or chemical separation of intact immunoglobulins. For example, a $F(ab')_2$ fragment can be obtained from an IgG molecule by proteolytic digestion with pepsin at pH 3.0-3.5 using standard methods such as those described in Harlow and Lane, Antibodies: A Laboratory Manual, Cold Spring Harbor Pubs., N.Y. (1988). Fab fragments may be obtained from $F(ab')_2$ fragments by limited reduction, or from whole antibody by digestion with papain in the presence of reducing agents. Fragments can also be produced by recombinant DNA techniques. Segments of nucleic acids encoding selected fragments are produced by digestion of full-length coding sequences with restriction enzymes, or by de novo synthesis. Often fragments are expressed in the form of phage-coat fusion proteins. This manner of expression is advantageous for affinity-sharpening of antibodies.

scFv

A "single-chain antibody" (scFv) is an antibody fragment that consists of a single polypeptide chain comprising a VL domain linked to a VH-domain wherein VL domain and VH domain are paired to form a monovalent molecule. Single chain antibody can be prepared according to method known in the art (see, for example, Bird et al., (1988) Science 242: 423-426 and Huston et al., (1988) Proc. Natl. Acad. Sci. USA 85:5879-5883). In one embodiment, LRP6 constructs are produced using scFvs as the LRP6 binding moiety by linking at least one half-life extender. The VH and VL domains used to make the scFv may be derived from the same or from different antibodies and linked together. The scFv comprises at least one, two, three, four, five, or six CDRs.

Methods for Generating scFvs and Mutant scFvs are Shown in PCT/EP2011/057200, Filed May 6, 2011; and PCT/EP2011/057202, Filed May 6, 2011, the Contents of which are Incorporated Herein by Reference in their Entirety). The Results for Thermostability of scFv are Depicted in FIGS. 32-35.

The scFv may be linked to the half-life extender in many different orientations. In one embodiment, at least one scFv is linked to the C-terminus of the half-life extender. In other embodiment, at least one scFv is linked to the N-terminus of the half-life extender. In other embodiment, at least one scFvs is linked to both the N-terminus and C-terminus of the half-life extender.

Linkers

ScFv molecules can be produced by linking VH and VL regions together using linkers. The scFv molecules comprise an scFv linker (e.g., a Ser-Gly linker) with an optimized length and/or amino acid composition. It is known that linker length can greatly affect how the variable regions of an scFv fold and interact. In fact, if a short linker is employed (e.g., between 5-10 amino acids; between 5-20 amino acids) intra-chain folding is prevented and interchain folding is required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

The scFv can comprise a linker sequence of at least 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, or more amino acid residues between its VL and VH regions. The linker sequence may be comprised of any naturally occurring amino acid. In some embodiments, the amino acids glycine and serine comprise the amino acids within the linker sequence. In another embodiment, the linker region orientation comprises sets of glycine repeats $(Gly_4Ser)_n$, where n is a positive integer equal to or greater than 1.

In one embodiment, the linkers include, but are not limited to, $(Gly_4\ Ser)_4$ or $(Gly_4Ser)_3$. In another embodiment, the linkers Glu and Lys residues can be interspersed within the Gly-Ser linkers for better solubility. In another embodiment, the linkers include multiple repeats of $(Gly_2Ser)$, (GlySer) or $(Gly_3Ser)$. In another embodiment, the linkers include combinations and multiples of $(Gly_3Ser)+(Gly_4Ser)+(GlySer)$. In another embodiment, Ser can be replaced with Ala e.g., $(Gly_4Ala)$ or $(Gly_3Ala)$. In yet another embodiment, the linker comprises the motif $(GluAlaAlaAlaLys)_n$, where n is a positive integer equal to or greater than 1.

scFv linkers can be of varying lengths. In one embodiment, an scFv linker is from about 5 to about 50 amino acids in length. In another embodiment, an scFv linker is from about 10 to about 40 amino acids in length. In another embodiment, an scFv linker is from about 15 to about 30 amino acids in length. In another embodiment, an scFv linker is from about 15 to about 20 amino acids in length. Variation in linker length may retain or enhance activity, giving rise to superior efficacy in activity studies. scFv linkers can be introduced into polypeptide sequences using techniques known in the art. For example, PCR mutagenesis can be used. Modifications can be confirmed by DNA sequence analysis. Plasmid DNA can be used to transform host cells for stable production of the polypeptides produced.

In one embodiment, a scFv molecule comprises an scFv linker having the amino acid sequence of $(Gly_4Ser)_3$ or $(Gly_4Ser)_4$ interposed between a VH domain and a VL domain, wherein the VH and VL domains are linked by a disulfide bond.

The scFv molecules can further comprise at least one disulfide bond which links an amino acid in the VL domain with an amino acid in the VH domain. Cysteine residues are necessary to provide disulfide bonds. Disulfide bonds can be included in an scFv molecule. Modifications of the genes which encode the VH and VL domains may be accomplished using techniques known in the art, for example, site-directed mutagenesis.

Stability and Mutations

The stability of scFv molecules can be evaluated in reference to the biophysical properties (e.g., thermal stability) of a conventional control scFv molecule or a full length antibody. In one embodiment, the LRP6 construct has a thermal stability that is greater than about 0.1, about 0.25, about 0.5, about 0.75, about 1, about 1.25, about 1.5, about 1.75, about 2, about 2.5, about 3, about 3.5, about 4, about 4.5, about 5, about 5.5, about 6, about 6.5, about 7, about 7.5, about 8, about 8.5, about 9, about 9.5, about 10 degrees, about 11 degrees, about 12 degrees, about 13 degrees, about 14 degrees, or about 15 degrees Celsius than a control binding molecule (e.g. a conventional scFv molecule) in the described assays.

The improved thermal stability of the scFv is subsequently conferred to the entire LRP6 construct. The thermal stability of the scFv can be improved by at least about 2° C. or 3° C. as compared to a conventional antibody. In one embodiment, the scFv has a 1° C. improved thermal stability as compared to a conventional antibody. In another embodiment, the scFv has a 2° C. improved thermal stability as compared to a conventional antibody. In another embodiment, the scFv has a 4, 5, 6, 7, 8, 9, 10, 11, 12, 13, 14, 15° C. improved thermal stability as compared to a conventional antibody. Comparisons can be made, for example, between the scFv molecules disclosed herein and scFv molecules or Fab fragments of an antibody from which the scFv VH and VL were derived. Thermal stability can be measured using methods known in the art. For example, in one embodiment, Tm can be measured. Methods for measuring Tm and other methods of determining protein stability are described in more detail below.

Mutations in scFv alter the stability of the scFv and improve the overall stability of the scFv and the LRP6 construct comprising the mutated scFv compared to a LRP6 construct without the mutated in the scFv. Mutations to the scFv can be generated as shown in the Examples. Stability of the mutated scFv is compared against the unmutated scFv using measurements such as Tm, temperature denaturation and temperature aggregation as described in the Examples. The binding capacity of the mutant scFvs can be determined using assays such as ELISA.

In one embodiment, the scFv comprises at least one mutation such that the mutated scFv confers improved stability to the LRP6 construct. In another embodiment, the scFv comprises at least 1, 2, 3, 4, 5, 6, 7, 8, 9, 10 mutations such that the mutated scFv confers improved stability to the LRP6 construct. In another embodiment, the scFv comprises a combination of mutations such that the mutated scFv confers improved stability to the LRP6 construct.

Methods of Evaluating Protein Stability

To assess the stability of LRP6 constructs, the stability of the minimal domain of a multidomain protein, as well as the entire multidomain protein, is predicted using the methods and those described below. Such methods allow for the determination of multiple thermal unfolding transitions where the least stable domain either unfolds first or limits the overall stability threshold of a multidomain unit that unfolds cooperatively (i.e. a multidomain protein which exhibits a single unfolding transition). The least stable domain can be identified in a number of additional ways. Mutagenesis can be performed to probe which domain limits the overall stability. Additionally, protease resistance of a multidomain protein can be performed under conditions where the least stable domain is known to be intrinsically unfolded via DSC or other spectroscopic methods (Fontana, et al., (1997) Fold. Des., 2: R17-26; Dimasi et al. (2009) J. Mol. Biol. 393: 672-692). Once the least stable domain is identified, the sequence encoding this domain (or a portion thereof) may be employed as a test sequence in the methods.

a) Thermal Stability

The thermal stability of the compositions may be analyzed using a number of non-limiting biophysical or biochemical techniques known in the art. In certain embodiments, thermal stability is evaluated by analytical spectroscopy.

An exemplary analytical spectroscopy method is Differential Scanning Calorimetry (DSC). DSC employs a calorimeter which is sensitive to the heat absorbances that accompany the unfolding of most proteins or protein domains (see, e.g. Sanchez-Ruiz, et al., Biochemistry, 27: 1648-52, 1988). To determine the thermal stability of a protein, a sample of the protein is inserted into the calorimeter and the temperature is raised until the Fab or scFv unfolds. The temperature at which the protein unfolds is indicative of overall protein stability.

Another exemplary analytical spectroscopy method is Circular Dichroism (CD) spectroscopy. CD spectrometry measures the optical activity of a composition as a function of increasing temperature. Circular dichroism (CD) spectroscopy measures differences in the absorption of left-handed polarized light versus right-handed polarized light which arise due to structural asymmetry. A disordered or unfolded structure results in a CD spectrum very different from that of an ordered or folded structure. The CD spectrum reflects the sensitivity of the proteins to the denaturing effects of increasing temperature and is therefore indicative of a protein's thermal stability (see van Mierlo and Steemsma, J. Biotechnol., 79(3):281-98, 2000).

Another exemplary analytical spectroscopy method for measuring thermal stability is Fluorescence Emission Spectroscopy (see van Mierlo and Steemsma, supra). Yet another exemplary analytical spectroscopy method for measuring thermal stability is Nuclear Magnetic Resonance (NMR) spectroscopy (see, e.g. van Mierlo and Steemsma, supra).

The thermal stability of a composition can be measured biochemically. An exemplary biochemical method for assessing thermal stability is a thermal challenge assay. In a "thermal challenge assay", a composition is subjected to a range of elevated temperatures for a set period of time. For example, in one embodiment, test scFv molecules or molecules comprising scFv molecules are subject to a range of increasing temperatures, e.g., for 1-1.5 hours. The activity of the protein is then assayed by a relevant biochemical assay. For example, if the protein is a binding protein (e.g. an scFv or scFv-containing polypeptide) the binding activity of the binding protein may be determined by a functional or quantitative ELISA.

Such an assay may be done in a high-throughput format and those disclosed in the Examples using *E. coli* and high throughput screening. A library of scFv variants may be created using methods known in the art. scFv expression may be induced an scFvs may be subjected to thermal challenge. The challenged test samples may be assayed for binding and those scFvs which are stable may be scaled up and further characterized.

Thermal stability is evaluated by measuring the melting temperature (Tm) of a composition using any of the above techniques (e.g. analytical spectroscopy techniques). The melting temperature is the temperature at the midpoint of a thermal transition curve wherein 50% of molecules of a composition are in a folded state (See e.g., Dimasi et al. (2009) J. Mol Biol. 393: 672-692). In one embodiment, Tm values for a scFv are about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an IgG is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an multivalent antibody is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C.

Thermal stability is also evaluated by measuring the specific heat or heat capacity (Cp) of a composition using an analytical calorimetric technique (e.g. DSC). The specific heat of a composition is the energy (e.g. in kcal/mol) is required to rise by 1° C., the temperature of 1 mol of water. As large Cp is a hallmark of a denatured or inactive protein composition. The change in heat capacity (ΔCp) of a composition is measured by determining the specific heat of a composition before and after its thermal transition. Thermal stability may also be evaluated by measuring or determining other parameters of thermodynamic stability including Gibbs free energy of unfolding (ΔG), enthalpy of unfolding (ΔH), or entropy of unfolding (ΔS). One or more of the above biochemical assays (e.g. a thermal challenge assay) are used to determine the temperature (i.e. the $T_C$ value) at which 50% of the composition retains its activity (e.g. binding activity).

In addition, mutations to the scFv alter the thermal stability of the scFv compared with the unmutated scFv. When the mutated scFv is incorporated into a LRP6 construct, the mutated scFv confers thermal stability to the overall LRP6 construct. In one embodiment, the scFv comprises a single mutation that confers thermal stability to the scFv. In another embodiment, the scFv comprises multiple mutations that confer thermal stability to the scFv. In one embodiment, the multiple mutations in the scFv have an additive effect on thermal stability of the scFv.

b) % Aggregation

The stability of a composition can be determined by measuring its propensity to aggregate. Aggregation can be measured by a number of non-limiting biochemical or biophysical techniques. For example, the aggregation of a composition may be evaluated using chromatography, e.g. Size-Exclusion Chromatography (SEC). SEC separates molecules on the basis of size. A column is filled with semi-solid beads of a polymeric gel that will admit ions and small molecules into their interior but not large ones. When a protein composition is applied to the top of the column, the compact folded proteins (i.e. non-aggregated proteins) are distributed through a larger volume of solvent than is available to the large protein aggregates. Consequently, the large aggregates move more rapidly through the column, and in this way the mixture can be separated or fractionated into its components. Each fraction can be separately quantified (e.g. by light scattering) as it elutes from the gel. Accordingly, the % aggregation of a composition can be determined by comparing the concentration of a fraction with the total concentration of protein applied to the gel. Stable compositions elute from the column as essentially a single fraction and appear as essentially a single peak in the elution profile or chromatogram.

c) Binding Affinity

The stability of a composition can be assessed by determining its target binding affinity. A wide variety of methods for determining binding affinity are known in the art. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jonsson, U., et al. (1993) Ann. Biol. Clin. 51:19-26; Jonsson, U., i (1991) Biotechniques 11:620-627; Johnsson, B., et al. (1995) J. Mol. Recognit. 8:125-131; and Johnsson, B., et al. (1991) Anal. Biochem. 198:268-277.

Other Antibody Fragments

Other antibody fragments such as Fabs, scFabs, can also be used to generate the LRP6 constructs. Single chain antibodies can also be used in the LRP6 constructs such as a "disbud" which consists of two chains, each chain comprising a heavy chain variable region connected to a light chain variable region on the same polypeptide chain connected by a short peptide linker, wherein the two regions on the same chain do not pair with each other but with complementary domains on the other chain to form a bispecific molecule. Methods of preparing diabodies are known in the art (See, e.g., Holliger et al., (1993) Proc. Natl. Acad. Sci. USA 90:6444-6448, and Poljak et al., (1994) Structure 2:1121-1123).

Domain antibodies (dAbs) can be used in the LRP6 constructs are small functional binding fragments of antibodies, corresponding to the variable regions of either the heavy or light chains of antibodies. Domain antibodies are well expressed in bacterial, yeast, and mammalian cell systems. Further details of domain antibodies and methods of production thereof are known in the art (see, for example, U.S. Pat. Nos. 6,291,158; 6,582,915; 6,593,081; 6,172,197; 6,696,245; European Patents 0368684 & 0616640; WO05/035572, WO04/101790, WO04/081026, WO04/058821, WO04/003019 and WO03/002609. Nanobodies are derived from the heavy chains of an antibody.

A nanobody typically comprises a single variable domain and two constant domains (CH2 and CH3) and retains antigen-binding capacity of the original antibody. Nanobodies can be prepared by methods known in the art (See e.g., U.S. Pat. No. 6,765,087, U.S. Pat. No. 6,838,254, WO 06/079372). Unibodies consist of one light chain and one heavy chain of a IgG4 antibody. Unibodies may be made by the removal of the hinge region of IgG4 antibodies. Further details of unibodies and methods of preparing them may be found in WO2007/059782.

Half-Life Extender Molecules

The present invention provides LRP6 conjugates comprising at least one LRP6 binding moiety and at least one half-life extender molecule such that the LRP6 construct binds to LRP6 and inhibits Wnt signaling without potentiation of the Wnt signal and displays an increased half-life in vitro and in vivo. The half-life extender molecule prolongs the therapeutic effect of the LRP6 construct in inhibiting a Wnt signal pathway. As such, the LRP6 constructs have desirable properties such as, an increased in vivo half-life of at least 5 hours, at least 10 hours, at least 15 hours, at least 20 hours, at least 25 hours, at least 30 hours, at least 35 hours, at least 40 hours, or more Several approaches can be taken to improve serum half-life of recombinant proteins, including PEGylation, glysosylation, fusion to antibody Fc domain, human serum albumin (HSA), polysialic acid (PSA), hydroxyethyl starch (HES), albumin-binding ligands, and carbohydrate shields; by genetic fusion to proteins binding to serum proteins, (e.g., HSA), IgG, FcRn, Fc, and transferrin; by coupling (genetically or chemically) to other LRP6 binding moieties that bind to serum proteins, such as nanobodies, Fabs, DARPins, avimers, affibodies, and anticalins; or by incorporation into nanocarriers, slow release formulations, or medical devices.

(i) Human Serum Albumin

In one embodiment, the invention provides LRP6 constructs comprising at least two LRP6 binding moieties linked to human serum albumin (HSA). HSA, a protein of 585 amino acids in its mature form, is responsible for a significant proportion of the osmotic pressure of serum and also functions as a carrier of endogenous and exogenous ligands. The role of albumin as a carrier molecule and its inert nature are desirable properties for use as a carrier and transporter of polypeptides in vivo. The use of albumin as a component of an albumin fusion protein as a carrier for various proteins has been suggested in WO 93/15199, WO 93/15200, and EP 413 622. The use of N-terminal fragments of HSA for fusions to polypeptides has also been proposed (EP 399 666). Accordingly, by genetically or chemically fusing or conjugating the antibodies or fragments thereof to albumin, can stabilize or extend the shelf-life, and/or to retain the molecule's activity for extended periods of time in solution, in vitro and/or in vivo.

Fusion of albumin to another protein may be achieved by genetic manipulation, such that the DNA coding for HSA, or a fragment thereof, is joined to the DNA coding for the protein. A suitable host is then transformed or transfected with the fused nucleotide sequences, so arranged on a suitable plasmid as to express a fusion polypeptide. The expression may be effected in vitro from, for example, prokaryotic or eukaryotic cells, or in vivo e.g. from a transgenic organism. Additional methods pertaining to HSA fusions can be found, for example, in WO 2001077137 and WO 200306007, incorporated herein by reference. In a specific embodiment, the expression of the fusion protein is performed in mammalian cell lines, for example, CHO cell lines.

In one embodiment, the HSA is wild-type HSA with SEQ ID NO: 209.

dahksevahrfkdlgeenfka-lyliafaqylqqcpfedhvklvnevte-faktcvadesaencdkslhtlfgdklctvatlretygema dccakqepernec-flqhkddnpnlprlvrpevdvmctafhdneetflkkylyeiarrhpyfy apellffakrykaafteccqaadka acllpkldelrdegkassakqrlk-caslqkfgerafkawavarlsqrfpkae-faevsklvtdltkvhtecchgdllecaddradlakyi cenqdsissklkeccek-pllekshciaevendempadlpslaadfveskdvcknyaeakdvflgm flyeyarrhpdysvvlllrla ktyettlekccaaadphecyakvyf-defkplveepqnlikqncelfeqlgeyk-fqnallvrytkkvpqvstptlvevsrnlgkvgskc ckhpeakrmpcaedylsv-vlnqlcvlhektpvsdrvtkccteslvnrrpcfsalevdetyvpke fnaetftfhadictlsekerqikk qtalvelvkhkpkatkeqlkavmd-dfaafvekcckaddketcfaeegkklvaasqaalgl (SEQ ID NO: 209).

In another embodiment, the HSA is mutant HSA with SEQ ID NO: 210

Dahksevahrfkdlgeenfkalv-liafaqylqqspfedhvklvnevtefak-tcvadesaencdkslhtlfgdklctvatlretygem adccakqepernecflqh-kddnpnlprlvrpevdvmctafhdneetflkkylyeiarrh pyfyapellffakrykaafteccqaadk aacllpkldelrdegkassakqrlk-caslqkfgerafkawavarlsqrfpkae-faevsklvtdltkvhtecchgdllecaddradlaky icenqdsissklkeccek-pllekshciaevendempadlpslaadfveskdvcknyaeakdvfl gmflyeyarrhpdysvvlllrl aktyettlekccaaadphecyakvf-defkplveepqnlikqncelfeqlgeyk-fqnallvrytkkvpqvstptlvevsrnlgkvgsk cckhpeakrmpcaedylsv-vlnqlcvlhektpvsdrvtkccteslvnrrpcfsalevdetyvpkef qaetftfhadictlsekerqik kqtalvelvkhkpkatkeqlkavmd-dfaafvekcckaddketcfaeegkklvaasqaalgl (SEQ ID NO: 210).

The mutated HSA has two amino acid substitutions (i.e., the "C34S" and "N503Q" substitutions, as set forth in SEQ ID NO: 210) relative to wild-type HSA. This mutated HSA contains two amino acid substitutions (i.e., serine for cysteine at amino acid residue 34 ("C345") and glutamine for asparagine at amino acid residue 503 ("N503Q")). The cysteine residue at position 34 (i.e., C34) can be mutated to any amino acid residue other than cysteine (e.g., serine, threonine, or alanine). Likewise, the asparagine residue at position 503 (i.e., N503) can be mutated to any amino acid residue other than asparagine (e.g., glutamine, serine, histidine, or alanine). Specifically, the substitution of serine for cysteine at amino acid residue 34 results in reduced oxidation and protein heterogeneity of the HSA. In wild-type HSA, the asparagine at amino acid residue 503 is sensitive to deamination, likely resulting in reduced pharmacologic half-life. The substitution of glutamine for asparagine at amino acid residue 503 can result in increased pharmacologic half-life of the HSA, and correspondingly, of LRP6 construct that include the HSA when administered to a mammal (e.g., a human) or cells, tissues, or organs thereof.

The invention further provides an LRP6 conjugates that are formed using a truncated wild-type HSA polypeptide, linked to LRP6 binding moieties with or without attachment linkers. A wild-type HSA polypeptide lacking 1, 2, 3, 4, 5, 10, 15, 20, 50, 100, 200 or more amino acids of the full-length wild-type HSA amino acid sequence (i.e., SEQ ID NO: 209) can be linked to any of the LRP6 binding moieties described herein. Truncations can occur at one or both ends of the HSA, or can include a deletion of internal residues. Truncation of more than one amino acid residue need not be linear (i.e., consecutive). Examples of wild-type HSA include those having, in combination with one or more attachment linkers or LRP6 binding moieties, one or more of domain I ("DI" residues 1-197 of SEQ ID NO:209) of HSA, domain II ("DII" residues 189-385 of SEQ ID NO: 209) of HSA, or domain III ("DIII" residues 381-585 of SEQ ID NO: 209) of HSA, or combinations thereof, e.g., domains I and II, I and III, and II and III of HSA. Serum clearance rates of the LRP6 conjugate can be optimized by testing conjugates containing a truncated wild-type HSA.

The half-life extender (e.g., HSA) may, but need not, be modified by site-specific chemical modification of amino acid residues in the HSA. The correctly-folded tertiary structure of HSA displays certain amino acid residues on the external face of the protein. Chemically-reactive amino acid residues (e.g., cysteine) can be substituted for these surface-exposed residues to allow site-specific conjugation of other agent.

Alternatively, or in addition, half-life extender (e.g., HSA) may optionally be modified by the addition or removal of asparagine, serine, or threonine residues from an HSA sequence to alter glycosylation of these amino acid residues. Glycosylation sites added to an HSA can be surface-exposed. Glycosyl or other carbohydrate moieties introduced to an HSA can be directly conjugated to diagnostic, therapeutic, or cytotoxic agents.

Surface-exposed amino acid residues of the half-life extender (e.g., HSA) may be substituted with cysteine residues to allow for chemical conjugation of diagnostic, therapeutic, or cytotoxic agents. Cysteine residues exposed on the surface of the HSA (when folded into its native tertiary structure) allow the specific conjugation of a diagnostic, therapeutic, or cytotoxic agent to a thiol reactive group such as maleimide or haloacetyl. The nucleophilic reactivity of the thiol functionality of a cysteine residue to a maleimide group is about 1000 times higher compared to any other amino acid functionality in a protein, such as the amino group of a lysine residue or the N-terminal amino group. Thiol specific functionality in iodoacetyl and maleimide reagents may react with amine groups, but higher pH (>9.0) and longer reaction times are required (Garman, 1997, Non-Radioactive Labelling: A Practical Approach, Academic Press, London). The amount of free thiol in a protein may be estimated using the standard Ellman's assay. In some instances, reduction of the disulfide bonds with a reagent such as dithiothreitol (DTT) or selenol (Singh et al, Anal. Biochem. 304:147-156 (2002)) is required to generate the reactive free thiol.

Sites for cysteine substitution can be identified by analysis of surface accessibility of the HSA. The surface accessibility can be expressed as the surface area (e.g., square angstroms) that can be contacted by a solvent molecule, e.g., water. The occupied space of water is approximated as a sphere with a 1.4 angstrom radius. Software for calculating the surface accessibility of each amino acid of a protein is freely available or licensable. For example, the CCP4 Suite of crystallography programs which employ algorithms to calculate the surface accessibility of each amino acid of a protein with known x-ray crystallography derived coordinates ("The CCP4 Suite: Programs for Protein Crystallography" Acta. Cryst. D50:760-763 (1994); www.ccp4.ac.uk/dist/html/INDEX.html). Solvent accessibility may also be assessed using the free software DeepView Swiss PDB Viewer downloaded from the Swiss Institute of Bioinformatics. The substitution of cysteines at surface-exposed sites allows for conjugation of the reactive cysteine to a thiol reactive group linked to the diagnostic or therapeutic agent. Glycosylation In addition, altered serum clearance rates can be achieved by engineering glycosylation sites into the half-life extender (e.g., HSA). In certain embodiments, an HSA can be glycosylated. Glycosylation of polypeptides is typically either N-linked or O-linked. N-linked refers to the attachment of a carbohydrate moiety to the side chain of an asparagine residue. The tripeptide sequences asparagine-X-serine and asparagine-X-threonine, where X represents any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used.

Addition or deletion of glycosylation sites to the HSA is conveniently accomplished by altering the amino acid sequence such that one or more of the above-described tripeptide sequences (for N-linked glycosylation sites) is created. The alteration may also be made by the addition, deletion, or substitution of one or more serine or threonine residues to the sequence of the HSA (for O-linked glycosylation sites). The resulting carbohydrate structures on HSA can also be used for site-specific conjugation of cytotoxic, immunomodulatory or cytostatic agents.

The half-life extender molecules such as HSA, can be incorporated into the LRP6 conjugate by direct or indirect linking with LRP6 binding moieties, e.g., scFv. The term "direct" linking refers to LRP6 binding moieties that are immediately bound to the half-life extender such that there is no gap between the LRP6 binding moiety and the half-life extender. The term "indirect" linking refers to LRP6 binding moieties that are not immediately bound to the half-life extender, but rather through an amino acid "attachment linker" between the LRP6 binding moiety and the half-life extender molecule. Examples of amino attachment linkers include, but are not limited to linkers comprising entirely of glycine, alanine, serine, glutamine, leucine, or valine residues linkers, or any combination of these residues. These amino acid attachment linkers can be 2, 3, 4, 5, 6, 7, 8, 9, 10, 11, 12, 13, 14, 15, 16, 17, 18, 19, 20 or more amino acids in length and provide a flexible tether between the LRP6 binding moiety and the half-life extender. The amino acid attachment linkers that can be attached (e.g., covalently (e.g., a peptidic bond), ionically, or hydrophobically bonded, or via a high-affinity protein-protein binding interaction (e.g., biotin and avidin)) to the C- or N-termini of a half-life extender such as HSA or mutated HSA.

(ii) Fc Fusions

This invention provides LRP6 constructs comprising at least one LRP6 binding moiety and at least one half-life extender molecule that is an Fc molecule. Native antibody molecule consists of two identical heavy chains, and two identical light chains. The heavy chain constant region includes CH1, the hinge region, CH2, and CH3. Papain digestion of antibodies produces two fragments, Fab and Fc. The Fc fragment consists of CH2, CH3, and part of the hinge region. It has been recognized that the Fc region is critical for maintaining the serum half-life of an antibody of class IgG (Ward and Ghetie, Ther. Immunol. 2:77-94 (1995)). Studies have found that the serum half-life of an IgG antibody is mediated by binding of Fc to the neonatal Fc receptor (FcRn). FcRn is a heterodimer consisting of a transmembrane a chain and a soluble β chain (β2-microglobulin). Advances in molecular biology techniques have allowed the preparation of novel chimeric polypeptides with multiple functional domains. The most common of such chimeric polypeptides are immunoglobulin (Ig) fusion proteins. These proteins consist of the Fc regions of antibodies, typically mouse or human antibodies, fused to an unrelated protein or protein fragment.

The term "Fc" as used herein refers to a polypeptide comprising the CH3, CH2 and at least a portion of the hinge region of a constant domain of an antibody. Optionally, an Fc region may include a CH4 domain, present in some antibody classes. An Fc may comprise the entire hinge region of a constant domain of an antibody. In one embodiment, the invention comprises an Fc and a CH1 region of an antibody. In one embodiment, the invention comprises an Fc and CH3 region of an antibody. In another embodiment, the invention comprises an Fc, a CH1 region and a Ckappa/lambda region from the constant domain of an antibody. Exemplary modifications include additions, deletions or substitutions of one or more amino acids in one or more domains. Such changes may be included to optimize effector function, half-life, etc.

LRP6 conjugates comprising Fc as a half-life extender may be produced by standard recombinant DNA techniques or by protein synthetic techniques, e.g., by use of a peptide synthesizer. For example, a nucleic acid molecule encoding a Fc fusion protein can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, e.g., "Current Protocols in Molecular Biology", Ausubel et al., eds., John Wiley & Sons, (1992)). Moreover, a nucleic acid encoding a bioactive molecule can be cloned into an expression vector containing the Fc domain or a fragment thereof such that the bioactive molecule is linked in-frame to the constant domain or fragment thereof.

Methods for fusing or conjugating polypeptides to the constant regions of antibodies are shown in the Examples section and are known in the art. See, e.g., U.S. Pat. Nos. 5,336,603, 5,622,929, 5,359,046, 5,349,053, 5,447,851, 5,723,125, 5,783,181, 5,908,626, 5,844,095, and 5,112,946; European Patent publications, EP 0 307 434; EP 0 367 166; EP 0 394 827; PCT publications WO 91/06570, WO 96/04388, WO 96/22024, WO 97/34631, and WO 99/04813; Ashkenazi et al., Proc. Natl. Acad. Sci. USA 88:10535-10539 (1991); Traunecker et al., Nature 331:84-86 (1988); Zheng et al., J. Immunol. 154:5590-5600 (1995); and Vil et al., Proc. Natl. Acad. Sci. USA 89:11337-11341 (1992), WO 98/23289; WO 97/34631; U.S. Pat. No. 6,277,375; WO 93/15199, WO 93/15200; WO 01/77137; and EP 413,622 each of which is incorporated herein by reference in its entirety. An LRP6 construct comprising a modified Fc as a half life extender is also within the scope of the invention.

(iii) PEGylation

In another embodiment, the LRP6 constructs comprise at least one half-life extender molecule that is a polyethylene glycol (PEG). To prolong the serum circulation of LRP6 conjugates in vivo, the LRP6 binding moieties can be linked to inert polymer molecules such as high molecular weight PEG with or without an attachment linker either through site-specific conjugation of the PEG to the N- or C-terminus of the LRP6 binding moiety or via epsilon-amino groups present on lysine residues. To PEGylate, an LRP6 binding moiety is typically reacted with polyethylene glycol (PEG), such as a reactive ester or aldehyde derivative of PEG, under conditions in which one or more PEG groups become attached to the LRP6 binding moiety. The PEGylation can be carried out by an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (C1-C10) alkoxy- or aryloxy-polyethylene glycol or polyethylene glycol-maleimide. Linear or branched polymer derivatization that results in minimal loss of biological activity can be used. The degree of conjugation can be closely monitored by SDS-PAGE and mass spectrometry to ensure proper conjugation of PEG molecules to the LRP6 binding moieties resulting in LRP6 conjugates. Unreacted PEG can be separated from LRP6 conjugates by size-exclusion or by ion-exchange chromatography. LRP6 conjugates can be tested for binding activity as well as for in vivo efficacy using methods well-known to those of skill in the art, for example, by immunoassays described herein. Methods for pegylating proteins are known in the art (See for example, EP 0 154 316 by Nishimura et al. and EP 0 401 384 by Ishikawa et al.).

Other modified pegylation technologies include reconstituting chemically orthogonal directed engineering technology (ReCODE PEG), which incorporates chemically specified side chains into biosynthetic proteins via a reconstituted system that includes tRNA synthetase and tRNA. This technology enables incorporation of more than 30 new amino acids into biosynthetic proteins in *E. coli*, yeast, and mammalian cells. The tRNA incorporates a normative amino acid any place an amber codon is positioned, converting the amber from a stop codon to one that signals incorporation of the chemically specified amino acid.

Recombinant pegylation technology (rPEG) can also be used for serum half-life extension. This technology involves genetically fusing a 300-600 amino acid unstructured protein tail to the LRP6 binding moiety. Because the apparent molecular weight of such an unstructured protein chain is about 15-fold larger than its actual molecular weight, the serum half-life of the LRP6 binding moiety will be greatly increased. In contrast to traditional PEGylation, which requires chemical conjugation and repurification, the manufacturing process is greatly simplified and the product is homogeneous.

(iv) PSA

In another embodiment, the LRP6 constructs comprise at least one half-life extender molecule that is polysialic acid (PSA). In Polysialytion is another technology, which uses the natural polymer PSA to prolong the active life and improve the stability of therapeutic peptides and proteins. PSA is a polymer of sialic acid (a sugar). When used for protein and therapeutic peptide drug delivery, polysialic acid provides a protective microenvironment on conjugation. This increases the active life of the LRP6 conjugate in the circulation and prevents it from being recognized by the immune system. The PSA polymer is naturally found in the human body. It was adopted by certain bacteria which evolved over millions of years to coat their walls with it. These naturally polysialylated bacteria were then able, by virtue of molecular mimicry, to foil the body's defense system. PSA, nature's ultimate stealth technology, can be easily produced from such bacteria in large quantities and with predetermined physical characteristics. Bacterial PSA is completely non-immunogenic, even when coupled to proteins, as it is chemically identical to PSA in the human body.

(v) HESylation

In another embodiment, the LRP6 constructs comprise at least one half-life extender molecule that is hydroxyethyl starch ("HES"). The use of HES derivatives linked to LRP6 binding moieties can result in an LRP6 conjugate with an extended half-life. HES is a modified natural polymer derived from waxy maize starch and can be metabolized by the body's enzymes. HES solutions are usually administered to substitute deficient blood volume and to improve the rheological properties of the blood. Hesylation of an LRP6 binding moiety enables the prolongation of the circulation half-life by increasing the stability of the molecule, as well as by reducing renal clearance, resulting in an increased biological activity. By varying different parameters, such as the molecular weight of HES, a wide range of HES LRP6 conjugates can be customized.

LRP6 Constructs

The present invention provides LRP6 conjugates comprising at least one LRP6 binding moiety and at least one half-life extender molecule such that the LRP6 construct binds to LRP6 and inhibits Wnt signaling with no significant potentiation of the Wnt signal and displays an increased half-life in vitro and in vivo. The half-life extender molecule prolongs the therapeutic effect of the LRP6 construct in inhibiting a Wnt signal pathway. As such, the LRP6 constructs have desirable properties such as, an increased in vivo half-life of at least 5 hours. The present invention is based on the discovery that the LRP6 constructs have the ability to inhibit both propeller 1 (e.g. Wnt1 and propeller 3 (e.g. Wnt3) ligand-mediated signaling and avoid potentiation of a Wnt signal. The LRP6 binding moieties of the LRP6 construct are designed to bind to distinct LRP6 β-propeller regions. At least one LRP6 binding moiety of the LRP6 construct comprises a Propeller 1 antibody or fragment thereof that binds to the β-propeller 1 domain and blocks propeller 1-dependent Wnts such as Wnt1, Wnt2, Wnt6, Wnt7A, Wnt7B, Wnt9, Wnt10A, Wnt10B to inhibit a Wnt 1 signal transduction pathway; and at least one LRP6 binding moiety of the LRP6 construct comprises a Propeller 3 antibody or fragment thereof that binds to the β-propeller 3 domain and blocks propeller 3-dependent Wnts such as Wnt3a and Wnt3 to inhibit a Wnt3 signal transduction pathway. In addition to the multiple binding effect of the LRP6 construct, the half-life of the LRP6 construct is also increased due to the half-life extender molecule. The half-life is increased by at least about 5 hours, at least 10 hours, at least 15 hours, at least 20 hours, at least 25 hours, at least 30 hours, at least 35 hours, at least 40 hours, or more, at least 10 hours, at least 15 hours, at least 20 hours, at least 25 hours, at least 30 hours, at least 35 hours, at least 40 hours, or more.

The LRP6 binding moiety includes, but is not limited to antibodies (e.g., monoclonal, polyclonal, recombinant, humanized, and chimeric antibodies), antibody fragments (e.g., scFvs, scFabs, Fab fragments, $Fab'_2$, SMIP, domain antibodies, diabodies, minibodies, scFv-Fc, affibodies, nanobodies, and domain antibodies), receptors, ligands, aptamers, and other molecules having a known binding partner. In one embodiment, the LRP6 construct is generated using at least two scFvs as LRP6 binding moieties. In one embodiment, the LRP6 construct is generated using at least one Fab as an LRP6 binding moiety. In one embodiment, the LRP6 construct is generated using at least one scFab as a LRP6 binding moiety. In one embodiment, the LRP6 construct is generated using any combination of LRP6 binding moieties. Representative examples of LRP6 constructs are shown in Table 2.

TABLE 2

| Examples of LRP6 constructs | | |
|---|---|---|
| SEQ ID NUMBER | Construct | Sequence |
| anti-LRP6_MOR08168 Fab-MSA | | |
| SEQ ID NO: 211 | 8168-VL/CL | DIELTQPPSVSVAPGQTARISCSGDSLRNKVYWYQQKPGQAPVLVIYKNNRPSGIPERFSGSNSGNTATLTISGTQA<br>EDEADYYCQSYDGQKSLVFGGGTKLTVLGQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTVEKTVAPTECS |
| SEQ ID NO: 212 | 8168-VL/CL-DNA | GATATCGAACTGACCCAGCCGCCTTCAGTGAGCGTTGCACCAGGTCAGACCGCGCGTATCTCGTGTAGCGGC<br>GATTCTCTTCGTAATAAGGTTTATTGGTACCAGCAGAAACCCGGGCAGGCGCCAGTTCTTGTGATTTATAAGA<br>ATAATCGTCCCTCAGGCATCCCGGAACGCTTTAGCGGATCCAACAGCGGCAACACCGCGACCCTGACCATTAG<br>CGGCACTCAGGCGGAAGACGAAGCGGATTATTATTGCCAGTCTTATGATGGTCAGAAGTCTCTTGTGTTTGGC<br>GGCGGCACGAAGCTTACCGTGCTGGGCCAGCCCAAAGCCGCCCCTAGCGTGACCCTGTTCCCCCCCAGCAGC<br>GAGGAACTGCAGGCCAACAAGGCCACCCTGGTCTGCCTGATCAGCGACTTCTACCCTGGCGCCGTGACCGTG<br>GCCTGGAAGGCCGACAGCAGCCCCGTGAAGGCCGGCGTGGAGACAACCACCCCCAGCAAGCAGAGCAACAA<br>CAAGTACGCCGCCAGCAGCTACCTGAGCCTGACCCCCGAGCAGTGGAAGAGCCACAGAAGCTACAGCTGCCA<br>GGTCACCCACGAGGGCAGCACCGTGGAGAAAACCGTGGCCCCCACCGAGTGCAGC |
| SEQ ID NO: 213 | 8168-VH/CH1-MSA | QVQLVESGGGLVQPGGSLRLSCAASGFTFSDYVINWVRQAPGKGLEWVSGISWSGVNTHYADSVKGRFTISRDN<br>SKNTLYLQMNSLRAEDTAVYYCARLGATANNIRYKFMDVWGQGTLVTVSSASTKGPSVFPLAPSSKSTSGGTAAL<br>GCLVKDYFPEPVTVSWNSGALTSGVHTFPAVLQSSGLYSLSSVVTVPSSSLGTQTYICNVNHKPSNTKVDKKVEPKS<br>CDKTHTEAHKSEIAHRYNDLGEQHFKGLVLIAFSQYLQKCSYDEHAKLVQEVTDFAKTCVADESAANCDKSLHTLFG<br>DKLCAIPNLRENYGELADCCTKQEPERNECFLQHKDDNPSLPPFERPEAEAMCTSFKENPTTFMGHYLHEVARRHP<br>YFYAPELLYYAEQYNEILTQCCAEADKESCLTPKLDGVKEKALVSSVRQRMKCSSMQKFGERAFKAWAVARLSQTF<br>PNADFAEITKLATDLTKVNKECCHGDLLECADDRAELAKYMCENQATISSKLQTCCDKPLLKKAHCLSEVEHDTMP<br>ADLPAIAADFVEDQEVCKNYAEAKDVFLGTFLYEYSRRHPDYSVSLLLRLAKKYEATLEKCCAEANPPACYGTVLAEF<br>QPLVEEPKNLVKTNCDLYEKLGEYGFQNAILVRYTQKAPQVSTPTLVEAARNLGRVGTKCCTLPEDQRLPCVEDYLS<br>AILNRVCLLHEKTPVSEHVTKCCSGSLVERRPCFSALTVDETYVPKEFKAETFTFHSDICTLPEKEKQIKKQTALAELVK<br>HKPKATAEQLKTVMDDFAQFLDTCCKAADKDTCFSTEGPNLVTRCKDALAHHHHHH |
| SEQ ID NO: 214 | 8168-VH/CH1-MSA-DNA | CAGGTGCAATTGGTGGAAAGCGGCGGCGGCCTGGTGCAACCGGGCGGCAGCCTGCGTCTGAGCTGCGCGGC<br>CTCCGGATTTACCTTTTCTGATTATGTTATTAATTGGGTGCGCCAAGCCCCTGGGAAGGGTCTCGAGTGGGTG<br>AGCGGTATTTCTTGGTCTGGTGTTAATACTCATTATGCTGATTCTGTTAAGGGTCGTTTTACCATTTCACGTGAT<br>AATTCGAAAAACACCCTGTATCTGCAAATGAACAGCCTGCGTGCGGAAGATACGGCCGTGTATTATTGCGCGC<br>GTCTTGGTGCTACTGCTAATAATATTCGTTATAAGTTTATGGATGTTTGGGGCCAAGGCACCCTGGTGACGGT<br>TAGCTCAGCTAGCACCAAGGGCCCCAGCGTGTTCCCCCTGGCCCCCAGCAGCAAGAGCACCTCTGGCGGCAC<br>TGCTGCCCTGGGCTGCCTGGTCAAGGACTACTTCCCCGAGCCCGTGACAGTGTCCTGGAACAGCGGAGCCCT<br>GACCTCCGGCGTGCACACCTTCCCCGCCGTGCTGCAGAGCAGCGGCCTGTACAGCCTGAGCAGCGTGGTCAC<br>AGTGCCCAGCAGCAGCCTGGGCACCCAGACCTACATCTGCAACGTGAACCACAAGCCCAGCAACACCAAGGT<br>CGACAAGAAGGTGGAGCCCAAGAGCTGCGACAAGACCCACACCGAGGCCCACAAGAGCGAGATCGCCCACC<br>GGTACAACGACCTGGGAGAGCAGCATTTCAAGGGACTGGTGCTGATCGCCTTCAGCCAGTACCTGCAGAAGT<br>GCAGCTACGACGAGCACGCCAAGCTGGTGCAGGAAGTGACCGACTTCGCCAAGACCTGCGTGGCCGACGAG<br>AGCGCCGCCAACTGCGACAAGAGCCTGCACACCCTGTTCGGCGACAAGCTGTGCGCCATCCCCAACCTGCGG<br>GAGAACTACGGCGAGCTGGCCGACTGCTGCACCAAGCAGGAACCCGAGCGGAACGAGTGCTTCCTGCAGCA<br>CAAGGACGACAACCCCAGCCTGCCCCCCTTCGAGAGGCCTGAGGCCGAGGCCATGTGCACCAGCTTCAAAGA<br>GAACCCCACCACCTTCATGGGCCACTACCTGCACGAGGTGGCCAGGCGGCACCCCTACTTCTACGCCCCCGAG |

TABLE 2-continued

Examples of LRP6 constructs

| SEQ ID NUMBER | Construct | Sequence |
|---|---|---|
| | | CTGCTGTACTACGCCGAGCAGTACAACGAGATCCTGACCCAGTGCTGCGCCGAGGCCGACAAAGAGAGCTGC CTGACCCCCAAGCTGGACGGCGTGAAAGAAAAGGCCCTGGTGTCCAGCGTGCGGCAGCGGATGAAGTGCAG CAGCATGCAGAAGTTCGGCGAGCGGGCCTTCAAGGCCTGGGCCGTGGCCCGGCTGTCCCAGACCTTCCCCAA CGCCGATTTCGCCGAGATCACCAAGCTGGCCACCGACCTGACCAAGGTGAACAAAGAGTGCTGTCACGGCGA CCTGCTGGAATGCGCCGACGACCGGGCCGAGCTGGCCAAGTACATGTGCGAGAACCAGGCCACCATCAGCTC CAAACTGCAGACCTGCTGTGATAAGCCCCTGCTGAAGAAGGCCCACTGCCTGAGCGAGGTGGAGCACGACAC CATGCCCGCCGACCTGCCCGCCATTGCCGCCGACTTCGTGGAGGACCAGGAAGTGTGCAAGAATTACGCCGA GGCCAAGGACGTGTTCCTGGGCACCTTCCTGTACGAGTACAGCAGACGGCACCCCGACTACAGCGTGAGCCT GCTGCTGAGGCTGGCCAAGAAGTACGAGGCCACCCTGGAAAAGTGTTGCGCCGAAGCCAACCCCCCTGCCTG CTACGGCACCGTGCTGGCCGAGTTCCAGCCCCTGGTGGAGGAACCCAAGAACCTGGTGAAAACCAACTGCGA TCTGTACGAGAAGCTGGGCGAGTACGGCTTCCAGAACGCCATCCTGGTCCGGTACACCCAGAAAGCCCCCCA GGTGTCCACCCCCACACTGGTGGAGGCCGCCAGGAACCTGGGCAGAGTCGGCACCAAGTGCTGCACCCTGCC CGAGGATCAGAGGCTGCCCTGTGTCGAGGACTACCTGAGCGCCATCCTGAACAGAGTGTGCCTGCTGCACGA GAAAACCCCCGTGAGCGAGCACGTGACCAAGTGTTGCAGCGGCAGCCTGGTGGAGCGGAGGCCCTGCTTCA GCGCCCTGACCGTGGACGAGACATACGTGCCCAAAGAGTTCAAGGCCGAGACATTCACCTTCCACAGCGACA TCTGTACCCTGCCTGAGAAAGAGAAGCAGATCAAGAAGCAGACCGCCCTGGCCGAACTGGTGAAGCACAAG CCCAAGGCCACCGCCGAGCAGCTGAAAACCGTGATGGACGACTTCGCCCAGTTCCTGGACACCTGCTGCAAG GCCGCCGACAAGGACACCTGTTTCAGCACCGAGGGCCCCAACCTGGTGACCCGGTGCAAGGACGCCCTGGCC CACCATCATCACCATCAC |
| anti-LRP6_MOR08168 Fab-MSA (C:S) | | |
| SEQ ID NO: 215 | 8168-VL/CL | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |
| SEQ ID NO: 216 | 8168-VL/CL-DNA | GACATCGAGCTGACCCAGCCCCCTTCTGTGTCTGTGGCCCCTGGCCAGACCGCCAGAATCAGCTGCAGCGGC GACAGCCTGCGGAACAAGGTGTACTGGTATCAGCAGAAGCCCGGCCAGGCTCCCGTGCTGGTGATCTACAAG AACAACCGGCCCAGCGGCATCCCTGAGCGGTTCAGCGGCAGCAACAGCGGCAATACCGCCACCCTGACCATC AGCGGCACCCAGGCCGAAGATGAGGCCGACTACTACTGCCAGAGCTACGACGGCCAGAAAAGCCTGGTGTT CGGCGGAGGCACCAAGCTTACCGTGCTGGGCCAGCCCAAAGCCGCCCCTAGCGTGACCCTGTTCCCCCCCAG CAGCGAGGAACTGCAGGCCAACAAGGCCACCCTGGTCTGCCTGATCAGCGACTTCTACCCTGGCGCCGTGAC CGTGGCCTGGAAGGCCGACAGCAGCCCCGTGAAGGCCGGCGTGGAGACAACCACCCCCAGCAAGCAGAGCA ACAACAAGTACGCCGCCAGCAGCTACCTGAGCCTGACCCCCGAGCAGTGGAAGAGCCACAGAAGCTACAGCT GCCAGGTCACCCACGAGGGCAGCACCGTGGAGAAAACCGTGGCCCCCACCGAGTGCAGC |
| SEQ ID NO: 217 | 8168-VH/CH1-MSA (C:S) | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKKVEPKS CDKTHTEAHKSEIAHRYNDLGEQHFKGLVLIAFSQYLQKSSYDEHAKLVQEVTDFAKTCVADESAANCDKSLHTLFG DKLCAIPNLRENYGELADCCTKQEPERNECFLQHKDDNPSLPPFERPEAEAMCTSFKENPTTFMGHYLHEVARRHP YFYAPELLYYAEQYNEILTQCCAEADKESCLTPKLDGVKEKALVSSVRQRMKCSSMQKFGERAFKAWAVARLSQTF PNADFAEITKLATDLTKVNKECCHGDLLECADDRAELAKYMCENQATISSKLQTCCDKPLLKKAHCLSEVEHDTMP ADLPAIAADFVEDQEVCKNYAEAKDVFLGTFLYEYSRRHPDYSVSLLLRLAKKYEATLEKCCAEANPPACYGTVLAEF QPLVEEPKNLVKTNCDLYEKLGEYGFQNAILVRYTQKAPQVSTPTLVEAARNLGRVGTKCCTLPEDQRLPCVEDYLS |

TABLE 2-continued

| SEQ ID NUMBER | Construct | Sequence |
|---|---|---|
| Examples of LRP6 constructs | | |
| | | AILNRVCLLHEKTPVSEHVTKCCSGSLVERRPCFSALTVDETYVPKEFKAETFTFHSDICTLPEKEKQIKKQTALAELVK HKPKATAEQLKTVMDDFAQFLDTCCKAADKDTCFSTEGPNLVTRSKDALAHHHHHH |
| SEQ ID NO: 218 | 8168-VH/CH1-MSA-(C:S)-DNA | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT GACCGTCAGCTCAGCTAGCACCAAGGGCCCCAGCGTGTTCCCCCTGGCCCCCAGCAGCAAGAGCACCTCTGG CGGCACTGCTGCCCTGGGCTGCCTGGTCAAGGACTACTTCCCCGAGCCCGTGACAGTGTCCTGGAACAGCGG AGCCCTGACCTCCGGCGTGCACACCTTCCCCGCCGTGCTGCAGAGCAGCGGCCTGTACAGCCTGAGCAGCGT GGTCACAGTGCCCAGCAGCAGCCTGGGCACCCAGACCTACATCTGCAACGTGAACCACAAGCCCAGCAACAC CAAGGTCGACAAGAAGGTGGAGCCCAAGAGCTGCGACAAGACCCACACCGAGGCCCACAAGAGCGAGATCG CCCACCGGTACAACGACCTGGGAGAGCAGCATTTCAAGGGACTGGTGCTGATCGCCTTCAGCCAGTACCTGC AGAAGTCCAGCTACGACGAGCACGCCAAGCTGGTGCAGGAAGTGACCGACTTCGCCAAGACCTGCGTGGCC GACGAGAGCGCCGCCAACTGCGACAAGAGCCTGCACACCCTGTTCGGCGACAAGCTGTGCGCCATCCCCAAC CTGCGGGAGAACTACGGCGAGCTGGCCGACTGCTGCACCAAGCAGGAACCCGAGCGGAACGAGTGCTTCCT GCAGCACAAGGACGACAACCCCAGCCTGCCCCCCTTCGAGAGGCCTGAGGCCGAGGCCATGTGCACCAGCTT CAAAGAGAACCCCACCACCTTCATGGGCCACTACCTGCACGAGGTGGCCAGGCGGCACCCCTACTTCTACGCC CCCGAGCTGCTGTACTACGCCGAGCAGTACAACGAGATCCTGACCCAGTGCTGCGCCGAGGCCGACAAAGAG AGCTGCCTGACCCCCAAGCTGGACGGCGTGAAAGAAAAGGCCCTGGTGTCCAGCGTGCGGCAGCGGATGAA GTGCAGCAGCATGCAGAAGTTCGGCGAGCGGGCCTTCAAGGCCTGGGCCGTGGCCCGGCTGTCCCAGACCTT CCCCAACGCCGATTTCGCCGAGATCACCAAGCTGGCCACCGACCTGACCAAGGTGAACAAAGAGTGCTGTCA CGGCGACCTGCTGGAATGCGCCGACGACCGGGCCGAGCTGGCCAAGTACATGTGCGAGAACCAGGCCACCA TCAGCTCCAAACTGCAGACCTGCTGTGATAAGCCCCTGCTGAAGAAGGCCCACTGCCTGAGCGAGGTGGAGC ACGACACCATGCCCGCCGACCTGCCCGCCATTGCCGCCGACTTCGTGGAGGACCAGGAAGTGTGCAAGAATT ACGCCGAGGCCAAGGACGTGTTCCTGGGCACCTTCCTGTACGAGTACAGCAGACGGCACCCCGACTACAGCG TGAGCCTGCTGCTGAGGCTGGCCAAGAAGTACGAGGCCACCCTGGAAAAGTGTTGCGCCGAAGCCAACCCCC CTGCCTGCTACGGCACCGTGCTGGCCGAGTTCCAGCCCCTGGTGGAGGAACCCAAGAACCTGGTGAAAACCA ACTGCGATCTGTACGAGAAGCTGGGCGAGTACGGCTTCCAGAACGCCATCCTGGTCCGGTACACCCAGAAAG CCCCCCAGGTGTCCACCCCCACACTGGTGGAGGCCGCCAGGAACCTGGGCAGAGTCGGCACCAAGTGCTGCA CCCTGCCCGAGGATCAGAGGCTGCCCTGTGTCGAGGACTACCTGAGCGCCATCCTGAACAGAGTGTGCCTGC TGCACGAGAAAACCCCCGTGAGCGAGCACGTGACCAAGTGTTGCAGCGGCAGCCTGGTGGAGCGGAGGCCC TGCTTCAGCGCCCTGACCGTGGACGAGACATACGTGCCCAAAGAGTTCAAGGCCGAGACATTCACCTTCCACA GCGACATCTGTACCCTGCCTGAGAAAGAGAAGCAGATCAAGAAGCAGACCGCCCTGGCCGAACTGGTGAAG CACAAGCCCAAGGCCACCGCCGAGCAGCTGAAAACCGTGATGGACGACTTCGCCCAGTTCCTGGACACCTGC TGCAAGGCCGCCGACAAGGACACCTGTTTCAGCACCGAGGGCCCCAACCTGGTGACCCGGTCCAAGGACGCC CTGGCCCACCATCATCACCATCAC |
| anti-LRP6_MOR08168 Fab-HSA (C:S) | | |
| SEQ ID NO: 219 | 8168-VL/CL | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |

TABLE 2-continued

| Examples of LRP6 constructs | | |
|---|---|---|
| SEQ ID NUMBER | Construct | Sequence |
| SEQ ID NO: 220 | 8168-VL/CL-DNA | GACATCGAGCTGACCCAGCCCCCTTCTGTGTCTGTGGCCCCTGGCCAGACCGCCAGAATCAGCTGCAGCGGC<br>GACAGCCTGCGGAACAAGGTGTACTGGTATCAGCAGAAGCCCGGCCAGGCTCCCGTGCTGGTGATCTACAAG<br>AACAACCGGCCCAGCGGCATCCCTGAGCGGTTCAGCGGCAGCAACAGCGGCAATACCGCCACCCTGACCATC<br>AGCGGCACCCAGGCCGAAGATGAGGCCGACTACTACTGCCAGAGCTACGACGGCCAGAAAAGCCTGGTGTT<br>CGGCGGAGGCACCAAGCTTACCGTGCTGGGCCAGCCCAAAGCCGCCCCTAGCGTGACCCTGTTCCCCCCCAG<br>CAGCGAGGAACTGCAGGCCAACAAGGCCACCCTGGTCTGCCTGATCAGCGACTTCTACCCTGGCGCCGTGAC<br>CGTGGCCTGGAAGGCCGACAGCAGCCCCGTGAAGGCCGGCGTGGAGACAACCACCCCCAGCAAGCAGAGCA<br>ACAACAAGTACGCCGCCAGCAGCTACCTGAGCCTGACCCCCGAGCAGTGGAAGAGCCACAGAAGCTACAGCT<br>GCCAGGTCACCCACGAGGGCAGCACCGTGGAGAAAACCGTGGCCCCCACCGAGTGCAGC |
| SEQ ID NO: 221 | 8168-VH/CH1-HSA (C:S) | QVQLVESGGGLVQPGGSLRLSCAASGFTFSDYVINWVRQAPGKGLEWVSGISWSGVNTHYADSVKGRFTISRDN<br>SKNTLYLQMNSLRAEDTAVYYCARLGATANNIRYKFMDVWGQGTLVTVSSASTKGPSVFPLAPSSKSTSGGTAAL<br>GCLVKDYFPEPVTVSWNSGALTSGVHTFPAVLQSSGLYSLSSVVTVPSSSLGTQTYICNVNHKPSNTKVDKKVEPKS<br>CDKTHTDAHKSEVAHRFKDLGEENFKALVLIAFAQYLQQSPFEDHVKLVNEVTEFAKTCVADESAENCDKSLHTLF<br>GDKLCTVATLRETYGEMADCCAKQEPERNECFLQHKDDNPNLPRLVRPEVDVMCTAFHDNEETFLKKYLYEIARR<br>HPYFYAPELLFFAKRYKAAFTECCQAADKAACLLPKLDELRDEGKASSAKQRLKCASLQKFGERAFKAWAVARLSQ<br>RFPKAEFAEVSKLVTDLTKVHTECCHGDLLECADDRADLAKYICENQDSISSKLKECCEKPLLEKSHCIAEVENDEMP<br>ADLPSLAADFVESKDVCKNYAEAKDVFLGMFLYEYARRHPDYSVVLLLRLAKTYETTLEKCCAAADPHECYAKVFDE<br>FKPLVEEPQNLIKQNCELFEQLGEYKFQNALLVRYTKKVPQVSTPTLVEVSRNLGKVGSKCCKHPEAKRMPCAEDYL<br>SVVLNQLCVLHEKTPVSDRVTKCCTESLVNRRPCFSALEVDETYVPKEFNAETFTFHADICTLSEKERQIKKQTALVEL<br>VKHKPKATKEQLKAVMDDFAAFVEKCCKADDKETCFAEEGKKLVAASQAALGL |
| SEQ ID NO: 222 | 8168-VH/CH1-HSA-(C:S)-DNA | CAGGTGCAATTGGTCGAGTCTGGCGGAGGACTGGTGCAGCCTGGTGGCAGCCTGAGACTGAGCTGCGCCGC<br>CAGCGGCTTCACCTTCAGCGACTACGTGATCAACTGGGTGCGACAGGCCCCTGGAAAGGGCCTGGAATGGGT<br>GTCCGGCATCTCTTGGTCTGGCGTGAACACCCACTACGCCGACAGCGTGAAGGGCCGGTTCACCATCAGCCG<br>GGACAACAGCAAGAACACCCTGTACCTGCAGATGAACAGCCTGAGAGCCGAGGACACCGCCGTGTACTACTG<br>TGCCAGACTGGGCGCCACCGCCAACAACATCCGGTACAAGTTCATGGACGTGTGGGGCCAGGGCACACTGGT<br>GACCGTCAGCTCAGCTAGCACCAAGGGCCCCAGCGTGTTCCCCCTGGCCCCCTCCAGCAAGTCCACAAGCGGT<br>GGCACAGCAGCTCTGGGTTGCCTGGTGAAGGACTACTTCCCCGAGCCCGTGACAGTGTCCTGGAACTCTGGC<br>GCCCTGACCTCCGGCGTGCACACCTTCCCCGCCGTGCTGCAGAGCAGCGGCCTGTACAGCCTGAGCAGCGTG<br>GTGACAGTCCCCAGCAGCAGCTTGGGCACCCAGACCTACATCTGCAACGTGAACCACAAGCCCAGCAACACC<br>AAGGTGGACAAGAAGGTGGAGCCCAAGAGCTGCGACAAGACCCACACCGACGCCCACAAGAGCGAGGTGG<br>CCCACCGGTTCAAGGACCTGGGCGAGGAAAACTTCAAGGCCCTGGTGCTGATCGCCTTCGCCCAGTACCTGC<br>AGCAGAGCCCCTTCGAAGATCACGTAAAGTTAGTCAACGAGGTTACGGAATTCGCAAAGACATGCGTTGCTG<br>ACGAATCCGCTGAGAATTGTGACAAGAGTTTGCACACTTTATTCGGAGATAAGTTGTGTACTGTAGCTACTTT<br>GAGAGAGACTTACGGTGAAATGGCTGACTGCTGTGCAAAACAGGAACCAGAACGTAACGAATGTTTCCTTCA<br>GCATAAGGATGATAACCCTAACCTTCCAAGGCTTGTTAGGCCAGAAGTCGACGTGATGTGCACCGCCTTCCAT<br>GATAATGAAGAGACTTTTCTTAAAAAGTACCTATACGAGATTGCAAGGCGTCATCCATATTTTTACGCCCCAGA<br>GCTGTTGTTTTTCGCAAAGAGATACAAAGCTGCATTTACTGAGTGTTGCCAAGCTGCCGACAAGGCCGCTTGT<br>TTGCTACCAAAGTTGGACGAATTGAGAGACGAGGGTAAGGCATCATCTGCCAAGCAGAGATTAAAATGTGCA<br>TCTTTGCAAAAATTTGGAGAGAGAGCTTTTAAGGCATGGGCTGTTGCCCGACTAAGCCAAAGATTCCCAAAAG<br>CCGAATTTGCTGAAGTATCCAAGCTGGTGACTGATTTGACTAAAGTACATACAGAATGTTGCCATGGCGACCT<br>TTTAGAATGTGCTGATGACAGAGCAGATTTGGCTAAGTATATCTGCGAAAATCAAGATTCAATCAGCTCTAAG<br>CTGAAGGAATGTTGCGAGAAACCACTGTTAGAAAAATCGCATTGTATTGCTGAAGTTGAAAATGATGAGATG<br>CCTGCTGACTTGCCTTCTCTTGCCGCTGATTTTGTTGAGTCGAAGGATGTCTGTAAGAATTATGCTGAAGCTAA<br>AGACGTTTTCCTGGGTATGTTCTTATATGAGTACGCAAGACGTCACCCAGATTACTCTGTGGTTCTGCTACTGA<br>GATTGGCTAAAACATACGAGACAACGCTGGAGAAGTGCTGTGCTGCCGCTGACCCTCATGAGTGCTATGCAA<br>AGGTTTTTGATGAATTCAAACCATTGGTTGAAGAGCCTCAAAACTTGATAAAGCAGAACTGTGAGCTGTTTGA |

TABLE 2-continued

| Examples of LRP6 constructs | | |
|---|---|---|
| SEQ ID NUMBER | Construct | Sequence |
| | | GCAATTGGGTGAGTATAAGTTCCAAAATGCCCTGTTGGTGAGATATACAAAAAGGTACCCCAAGTTTCAACG<br>CCCACTTTAGTTGAAGTGTCCAGAAATCTTGGTAAAGTGGGTAGCAAATGTTGCAAGCATCCAGAAGCCAAG<br>CGAATGCCCTGTGCTGAGGATTATCTGTCCGTCGTGTTGAACCAATTGTGCGTATTACACGAAAAAACCCCAG<br>TCTCTGATAGAGTCACCAAATGTTGCACTGAGTCACTAGTTAATAGAAGGCCTTGTTTTTCCGCTTTGGAAGTT<br>GATGAAACCTACGTGCCTAAGGAATTTAACGCTGAGACCTTTACCTTTCACGCTGACATTTGTACTTTGAGTGA<br>AAAAGAGCGTCAAATCAAAAAGCAAACCGCTCTTGTTGAATTGGTGAAACACAAGCCTAAGGCTACGAAGGA<br>GCAGCTTAAAGCCGTCATGGACGATTTCGCCGCATTTGTTGAAAAATGCTGTAAAGCTGATGACAAGGAAAC<br>ATGTTTCGCTGAAGAGGGAAAGAAATTGGTTGCGGCCAGTCAGGCCGCACTTGGTTTG |
| anti-LRP6_MOR08545-MSA | | |
| SEQ ID NO: 223 | 8545-VL/CL | DIELTQPPSVSVAPGQTARISCSGDNIGSKYVHWYQQKPGQAPVLVIYGDSNRPSGIPERFSGSNSGNTATLTISGT<br>QAEDEADYYCTRTSTPISGVFGGGTKLTVLGQPKAAPSVTLFPPSSEELQANKATLVCLISDFYPGAVTVAWKADSS<br>PVKAGVETTTPSKQSNNKYAASSYLSLTPEQWKSHRSYSCQVTHEGSTVEKTVAPTECS |
| SEQ ID NO: 224 | 8545-VL/CL-DNA | GACATCGAGCTGACCCAGCCCCCCAGCGTGTCTGTGGCCCCTGGCCAGACCGCCCGGATCAGCTGCAGCGGC<br>GACAACATCGGCAGCAAATACGTGCACTGGTATCAGCAGAAGCCCGGCCAGGCCCCCGTGCTGGTCATCTAC<br>GGCGACAGCAACCGGCCCAGCGGCATCCCCGAGCGGTTCAGCGGCAGCAACAGCGGCAACACCGCCACCCT<br>GACCATCAGCGGCACCCAGGCCGAGGACGAGGCCGACTACTACTGCACCCGGACCAGCACCCCCATCTCCGG<br>CGTGTTTGGCGGCGGAACAAAGCTGACCGTGCTGGGCCAGCCCAAAGCCGCCCCTAGCGTGACCCTGTTCCC<br>CCCCAGCAGCGAGGAACTGCAGGCCAACAAGGCCACCCTGGTCTGCCTGATCAGCGACTTCTACCCTGGCGC<br>CGTGACCGTGGCCTGGAAGGCCGACAGCAGCCCCGTGAAGGCCGGCGTGGAGACAACCACCCCCAGCAAGC<br>AGAGCAACAACAAGTACGCCGCCAGCAGCTACCTGAGCCTGACCCCCGAGCAGTGGAAGAGCCACAGAAGC<br>TACAGCTGCCAGGTCACCCACGAGGGCAGCACCGTGGAGAAAACCGTGGCCCCCACCGAGTGCAGC |
| SEQ ID NO: 225 | 8545-VH/CH1-MSA | QVQLVESGGGLVQPGGSLRLSCAASGFTFSVNGMHWVRQAPGKGLEWVSVIDGMGHTYYADSVKGRFTISRDN<br>SKNTLYLQMNSLRAEDTAVYYCARYDYIKYGAFDPWGQGTLVTVSSASTKGPSVFPLAPSSKSTSGGTAALGCLVK<br>DYFPEPVTVSWNSGALTSGVHTFPAVLQSSGLYSLSSVVTVPSSSLGTQTYICNVNHKPSNTKVDKKVEPKSCDKTH<br>TEAHKSEIAHRYNDLGEQHFKGLVLIAFSQYLQKCSYDEHAKLVQEVTDFAKTCVADESAANCDKSLHTLFGDKLCA<br>IPNLRENYGELADCCTKQEPERNECFLQHKDDNPSLPPFERPEAEAMCTSFKENPTTFMGHYLHEVARRHPYFYAP<br>ELLYYAEQYNEILTQCCAEADKESCLTPKLDGVKEKALVSSVRQRMKCSSMQKFGERAFKAWAVARLSQTFPNAD<br>FAEITKLATDLTKVNKECCHGDLLECADDRAELAKYMCENQATISSKLQTCCDKPLLKKAHCLSEVEHDTMPADLPA<br>IAADFVEDQEVCKNYAEAKDVFLGTFLYEYSRRHPDYSVSLLLRLAKKYEATLEKCCAEANPPACYGTVLAEFQPLVE<br>EPKNLVKTNCDLYEKLGEYGFQNAILVRYTQKAPQVSTPTLVEAARNLGRVGTKCCTLPEDQRLPCVEDYLSAILNR<br>VCLLHEKTPVSEHVTKCCSGSLVERRPCFSALTVDETYVPKEFKAETFTFHSDICTLPEKEKQIKKQTALAELVKHKPK<br>ATAEQLKTVMDDFAQFLDTCCKAADKDTCFSTEGPNLVTRCKDALAHHHHHH |
| SEQ ID NO: 226 | 8545-VH/CH1-MSA-DNA | CAGGTGCAGCTGGTCGAGTCTGGCGGGGGACTGGTCCAGCCTGGCGGCAGCCTGAGACTGAGCTGCGCCGC<br>CAGCGGCTTCACCTTCAGCGTGAACGGCATGCACTGGGTCCGCCAGGCACCAGGCAAGGGCCTGGAATGGG<br>TGTCCGTGATCGACGGCATGGGCCACACCTACTACGCCGACAGCGTGAAGGGCCGGTTCACCATCAGCCGGG<br>ACAACAGCAAGAACACCCTGTACCTGCAGATGAACAGCCTGCGGGCCGAGGACACCGCCGTGTACTACTGCG<br>CCAGATACGACTACATCAAGTACGGCGCCTTCGACCCCTGGGGCCAGGGCACACTGGTCACCGTGTCCAGCG<br>CTAGCACCAAGGGCCCCAGCGTGTTCCCCCTGGCCCCCAGCAGCAAGAGCACCTCTGGCGGCACTGCTGCCCT<br>GGGCTGCCTGGTCAAGGACTACTTCCCCGAGCCCGTGACAGTGTCCTGGAACAGCGGAGCCCTGACCTCCGG<br>CGTGCACACCTTCCCCGCCGTGCTGCAGAGCAGCGGCCTGTACAGCCTGAGCAGCGTGGTCACAGTGCCCAG<br>CAGCAGCCTGGGCACCCAGACCTACATCTGCAACGTGAACCACAAGCCCAGCAACACCAAGGTGGACAAGAA |

TABLE 2-continued

Examples of LRP6 constructs

| SEQ ID NUMBER | Construct | Sequence |
|---|---|---|
| | | GGTGGAGCCCAAGAGCTGCGACAAGACCCACACCGAGGCCCACAAGAGCGAGATCGCCCACCGGTACAACG<br>ACCTGGGAGAGCAGCATTTCAAGGGACTGGTGCTGATCGCCTTCAGCCAGTACCTGCAGAAGTGCAGCTACG<br>ACGAGCACGCCAAGCTGGTGCAGGAAGTGACCGACTTCGCCAAGACCTGCGTGGCCGACGAGAGCGCCGCC<br>AACTGCGACAAGAGCCTGCACACCCTGTTCGGCGACAAGCTGTGCGCCATCCCCAACCTGCGGGAGAACTAC<br>GGCGAGCTGGCCGACTGCTGCACCAAGCAGGAACCCGAGCGGAACGAGTGCTTCCTGCAGCACAAGGACGA<br>CAACCCCAGCCTGCCCCCCTTCGAGAGGCCTGAGGCCGAGGCCATGTGCACCAGCTTCAAAGAGAACCCCAC<br>CACCTTCATGGGCCACTACCTGCACGAGGTGGCCAGGCGGCACCCCTACTTCTACGCCCCCGAGCTGCTGTAC<br>TACGCCGAGCAGTACAACGAGATCCTGACCCAGTGCTGCGCCGAGGCCGACAAAGAGAGCTGCCTGACCCCC<br>AAGCTGGACGGCGTGAAAGAAAAGGCCCTGGTGTCCAGCGTGCGGCAGCGGATGAAGTGCAGCAGCATGC<br>AGAAGTTCGGCGAGCGGGCCTTCAAGGCCTGGGCCGTGGCCCGGCTGTCCCAGACCTTCCCCAACGCCGATT<br>TCGCCGAGATCACCAAGCTGGCCACCGACCTGACCAAGGTGAACAAAGAGTGCTGTCACGGCGACCTGCTGG<br>AATGCGCCGACGACCGGGCCGAGCTGGCCAAGTACATGTGCGAGAACCAGGCCACCATCAGCTCCAAACTGC<br>AGACCTGCTGTGATAAGCCCCTGCTGAAGAAGGCCCACTGCCTGAGCGAGGTGGAGCACGACACCATGCCCG<br>CCGACCTGCCCGCCATTGCCGCCGACTTCGTGGAGGACCAGGAAGTGTGCAAGAATTACGCCGAGGCCAAGG<br>ACGTGTTCCTGGGCACCTTCCTGTACGAGTACAGCAGACGGCACCCCGACTACAGCGTGAGCCTGCTGCTGA<br>GGCTGGCCAAGAAGTACGAGGCCACCCTGGAAAAGTGTTGCGCCGAAGCCAACCCCCCTGCCTGCTACGGCA<br>CCGTGCTGGCCGAGTTCCAGCCCCTGGTGGAGGAACCCAAGAACCTGGTGAAAACCAACTGCGATCTGTACG<br>AGAAGCTGGGCGAGTACGGCTTCCAGAACGCCATCCTGGTCCGGTACACCCAGAAAGCCCCCCAGGTGTCCA<br>CCCCCACACTGGTGGAGGCCGCCAGGAACCTGGGCAGAGTCGGCACCAAGTGCTGCACCCTGCCCGAGGATC<br>AGAGGCTGCCCTGTGTCGAGGACTACCTGAGCGCCATCCTGAACAGAGTGTGCCTGCTGCACGAGAAAACCC<br>CCGTGAGCGAGCACGTGACCAAGTGTTGCAGCGGCAGCCTGGTGGAGCGGAGGCCCTGCTTCAGCGCCCTG<br>ACCGTGGACGAGACATACGTGCCCAAAGAGTTCAAGGCCGAGACATTCACCTTCCACAGCGACATCTGTACCC<br>TGCCTGAGAAAGAGAAGCAGATCAAGAAGCAGACCGCCCTGGCCGAACTGGTGAAGCACAAGCCCAAGGCC<br>ACCGCCGAGCAGCTGAAAACCGTGATGGACGACTTCGCCCAGTTCCTGGACACCTGCTGCAAGGCCGCCGAC<br>AAGGACACCTGTTTCAGCACCGAGGGCCCCAACCTGGTGACCCGGTGCAAGGACGCCCTGGCCCACCATCAT<br>CACCATCAC |
| anti-LRP6_MOR06707-MSA | | |
| SEQ ID NO: 227 | 6707-VL/CL | DIELTQPPSVSVAPGQTARISCSGDNIGSKYVHWYQQKPGQAPVLVIYGDSNRPSGIPERFSGSNSGNTATLTISGT<br>QAEDEADYYCSSYDLARTVFGGGTKLTVLGQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTVEKTVAPTECS |
| SEQ ID NO: 228 | 6707-VL/CL-DNA | GACATCGAGCTGACCCAGCCCCCCAGCGTGTCTGTGGCCCCTGGCCAGACCGCCCGGATCAGCTGCAGCGGC<br>GACAACATCGGCAGCAAATACGTGCACTGGTATCAGCAGAAGCCCGGCCAGGCCCCCGTGCTGGTCATCTAC<br>GGCGACAGCAACCGGCCCAGCGGCATCCCCGAGCGGTTCAGCGGCAGCAACAGCGGCAACACCGCCACCCT<br>GACCATCAGCGGCACCCAGGCCGAGGACGAGGCCGACTACTACTGCAGCAGCTACGACCTGGCCCGGACCG<br>TGTTTGGCGGCGGAACAAAGCTGACCGTGCTGGGCCAGCCCAAAGCCGCCCCTAGCGTGACCCTGTTCCCCC<br>CCAGCAGCGAGGAACTGCAGGCCAACAAGGCCACCCTGGTCTGCCTGATCAGCGACTTCTACCCTGGCGCCG<br>TGACCGTGGCCTGGAAGGCCGACAGCAGCCCCGTGAAGGCCGGCGTGGAGACAACCACCCCCAGCAAGCAG<br>AGCAACAACAAGTACGCCGCCAGCAGCTACCTGAGCCTGACCCCCGAGCAGTGGAAGAGCCACAGAAGCTAC<br>AGCTGCCAGGTCACCCACGAGGGCAGCACCGTGGAGAAAACCGTGGCCCCCACCGAGTGCAGC |
| SEQ ID NO: 229 | 6707-VH/CH1-MSA | QVQLVESGGGLVQPGGSLRLSCAASGFTFSVNGMHWVRQAPGKGLEWVSNISGSSSFTYYADSVKGRFTISRDN<br>SKNTLYLQMNSLRAEDTAVYYCARYDYIKYGAFDPWGQGTLVTVSSASTKGPSVFPLAPSSKSTSGGTAALGCLVK<br>DYFPEPVTVSWNSGALTSGVHTFPAVLQSSGLYSLSSVVTVPSSSLGTQTYICNVNHKPSNTKVDKKVEPKSCDKTH |

TABLE 2-continued

Examples of LRP6 constructs

| SEQ ID NUMBER | Construct | Sequence |
|---|---|---|
| | | TEAHKSEIAHRYNDLGEQHFKGLVLIAFSQYLQKCSYDEHAKLVQEVTDFAKTCVADESAANCDKSLHTLFGDKLCA IPNLRENYGELADCCTKQEPERNECFLQHKDDNPSLPPFERPEAEAMCTSFKENPTTFMGHYLHEVARRHPYFYAP ELLYYAEQYNEILTQCCAEADKESCLTPKLDGVKEKALVSSVRQRMKCSSMQKFGERAFKAWAVARLSQTFPNAD FAEITKLATDLTKVNKECCHGDLLECADDRAELAKYMCENQATISSKLQTCCDKPLLKKAHCLSEVEHDTMPADLPA IAADFVEDQEVCKNYAEAKDVFLGTFLYEYSRRHPDYSVSLLLRLAKKYEATLEKCCAEANPPACYGTVLAEFQPLVE EPKNLVKTNCDLYEKLGEYGFQNAILVRYTQKAPQVSTPTLVEAARNLGRVGTKCCTLPEDQRLPCVEDYLSAILNR VCLLHEKTPVSEHVTKCCSGSLVERRPCFSALTVDETYVPKEFKAETFTFHSDICTLPEKEKQIKKQTALAELVKHKPK ATAEQLKTVMDDFAQFLDTCCKAADKDTCFSTEGPNLVTRCKDALAHHHHHH |
| SEQ ID NO: 230 | 6707-VH/CH1-MSA-DNA | CAGGTGCAGCTGGTCGAGTCTGGCGGGGGACTGGTCCAGCCTGGCGGCAGCCTGAGACTGAGCTGCGCCGC CAGCGGCTTCACCTTCAGCGTGAACGGCATGCACTGGGTCCGCCAGGCACCAGGCAAGGGCCTGGAATGGG TGTCCAACATCAGCGGCAGCAGCAGCTTCACCTACTACGCCGACAGCGTGAAGGGCCGGTTCACCATCAGCC GGGACAACAGCAAGAACACCCTGTACCTGCAGATGAACAGCCTGCGGGCCGAGGACACCGCCGTGTACTACT GCGCCAGATACGACTACATCAAGTACGGCGCCTTCGACCCCTGGGGCCAGGGCACACTGGTCACCGTGTCCA GCGCTAGCACCAAGGGCCCCAGCGTGTTCCCCCTGGCCCCCAGCAGCAAGAGCACCTCTGGCGGCACTGCTG CCCTGGGCTGCCTGGTCAAGGACTACTTCCCCGAGCCCGTGACAGTGTCCTGGAACAGCGGAGCCCTGACCTC CGGCGTGCACACCTTCCCCGCCGTGCTGCAGAGCAGCGGCCTGTACAGCCTGAGCAGCGTGGTCACAGTGCC CAGCAGCAGCCTGGGCACCCAGACCTACATCTGCAACGTGAACCACAAGCCCAGCAACACCAAGGTGGACAA GAAGGTGGAGCCCAAGAGCTGCGACAAGACCCACACCGAGGCCCACAAGAGCGAGATCGCCCACCGGTACA ACGACCTGGGAGAGCAGCATTTCAAGGGACTGGTGCTGATCGCCTTCAGCCAGTACCTGCAGAAGTGCAGCT ACGACGAGCACGCCAAGCTGGTGCAGGAAGTGACCGACTTCGCCAAGACCTGCGTGGCCGACGAGAGCGCC GCCAACTGCGACAAGAGCCTGCACACCCTGTTCGGCGACAAGCTGTGCGCCATCCCCAACCTGCGGGAGAAC TACGGCGAGCTGGCCGACTGCTGCACCAAGCAGGAACCCGAGCGGAACGAGTGCTTCCTGCAGCACAAGGA CGACAACCCCAGCCTGCCCCCCTTCGAGAGGCCTGAGGCCGAGGCCATGTGCACCAGCTTCAAAGAGAACCC CACCACCTTCATGGGCCACTACCTGCACGAGGTGGCCAGGCGGCACCCCTACTTCTACGCCCCCGAGCTGCTG TACTACGCCGAGCAGTACAACGAGATCCTGACCCAGTGCTGCGCCGAGGCCGACAAAGAGAGCTGCCTGACC CCCAAGCTGGACGGCGTGAAAGAAAAGGCCCTGGTGTCCAGCGTGCGGCAGCGGATGAAGTGCAGCAGCAT GCAGAAGTTCGGCGAGCGGGCCTTCAAGGCCTGGGCCGTGGCCCGGCTGTCCCAGACCTTCCCCAACGCCGA TTTCGCCGAGATCACCAAGCTGGCCACCGACCTGACCAAGGTGAACAAAGAGTGCTGTCACGGCGACCTGCT GGAATGCGCCGACGACCGGGCCGAGCTGGCCAAGTACATGTGCGAGAACCAGGCCACCATCAGCTCCAAACT GCAGACCTGCTGTGATAAGCCCCTGCTGAAGAAGGCCCACTGCCTGAGCGAGGTGGAGCACGACACCATGCC CGCCGACCTGCCCGCCATTGCCGCCGACTTCGTGGAGGACCAGGAAGTGTGCAAGAATTACGCCGAGGCCAA GGACGTGTTCCTGGGCACCTTCCTGTACGAGTACAGCAGACGGCACCCCGACTACAGCGTGAGCCTGCTGCT GAGGCTGGCCAAGAAGTACGAGGCCACCCTGGAAAAGTGTTGCGCCGAAGCCAACCCCCCTGCCTGCTACGG CACCGTGCTGGCCGAGTTCCAGCCCCTGGTGGAGGAACCCAAGAACCTGGTGAAAACCAACTGCGATCTGTA CGAGAAGCTGGGCGAGTACGGCTTCCAGAACGCCATCCTGGTCCGGTACACCCAGAAAGCCCCCCAGGTGTC CACCCCCACACTGGTGGAGGCCGCCAGGAACCTGGGCAGAGTCGGCACCAAGTGCTGCACCCTGCCCGAGG ATCAGAGGCTGCCCTGTGTCGAGGACTACCTGAGCGCCATCCTGAACAGAGTGTGCCTGCTGCACGAGAAAA CCCCCGTGAGCGAGCACGTGACCAAGTGTTGCAGCGGCAGCCTGGTGGAGCGGAGGCCCTGCTTCAGCGCC CTGACCGTGGACGAGACATACGTGCCCAAAGAGTTCAAGGCCGAGACATTCACCTTCCACAGCGACATCTGT ACCCTGCCTGAGAAAGAGAAGCAGATCAAGAAGCAGACCGCCCTGGCCGAACTGGTGAAGCACAAGCCCAA GGCCACCGCCGAGCAGCTGAAAACCGTGATGGACGACTTCGCCCAGTTCCTGGACACCTGCTGCAAGGCCGC CGACAAGGACACCTGTTTCAGCACCGAGGGCCCCAACCTGGTGACCCGGTGCAAGGACGCCCTGGCCCACCA TCATCACCATCAC |
| anti-LRP6_MOR06706-MSA | | |

TABLE 2-continued

Examples of LRP6 constructs

| SEQ ID NUMBER | Construct | Sequence |
|---|---|---|
| SEQ ID NO: 231 | 6706-VL/CL | DIELTQPPSVSVAPGQTARISCSGDNIRKKYVYWYQQKPGQAPVLVIYEDSKRPSGIPERFSGSNSGNTATLTISGTQ AEDEADYYCSTADSGINNGVFGGGTKLTVLGQPKAAPSVTLFPPSSEELQANKATLVCLISDFYPGAVTVAWKADS SPVKAGVETTTPSKQSNNKYAASSYLSLTPEQWKSHRSYSCQVTHEGSTVEKTVAPTECS |
| SEQ ID NO: 232 | 6706-VL/CL-DNA | GATATCGAACTGACCCAGCCGCCTTCAGTGAGCGTTGCACCAGGTCAGACCGCGCGTATCTCGTGTAGCGGC GATAATATTCGTAAGAAGTATGTTTATTGGTACCAGCAGAAACCCGGGCAGGCGCCAGTTCTTGTGATTTATG AGGATTCTAAGCGTCCCTCAGGCATCCCGGAACGCTTTAGCGGATCCAACAGCGGCAACACCGCGACCCTGA CCATTAGCGGCACTCAGGCGGAAGACGAAGCGGATTATTATTGCTCTACTGCTGATTCTGGTATTAATAATGG TGTGTTTGGCGGCGGCACGAAGCTTACCGTGCTGGGCCAGCCCAAAGCCGCCCCTAGCGTGACCCTGTTCCCC CCCAGCAGCGAGGAACTGCAGGCCAACAAGGCCACCCTGGTCTGCCTGATCAGCGACTTCTACCCTGGCGCC GTGACCGTGGCCTGGAAGGCCGACAGCAGCCCCGTGAAGGCCGGCGTGGAGACAACCACCCCCAGCAAGCA GAGCAACAACAAGTACGCCGCCAGCAGCTACCTGAGCCTGACCCCCGAGCAGTGGAAGAGCCACAGAAGCT ACAGCTGCCAGGTCACCCACGAGGGCAGCACCGTGGAGAAAACCGTGGCCCCCACCGAGTGCAGC |
| SEQ ID NO: 233 | 6706-VH/CH1-MSA | QVQLVESGGGLVQPGGSLRLSCAASGFTFSDYAIHWVRQAPGKGLEWVSGISYSGSSTHYADSVKGRFTISRDNSK NTLYLQMNSLRAEDTAVYYCARGSHGNIMAKRYFDFWGQGTLVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDK THTEAHKSEIAHRYNDLGEQHFKGLVLIAFSQYLQKCSYDEHAKLVQEVTDFAKTCVADESAANCDKSLHTLFGDKL CAIPNLRENYGELADCCTKQEPERNECFLQHKDDNPSLPPFERPEAEAMCTSFKENPTTFMGHYLHEVARRHPYFY APELLYYAEQYNEILTQCCAEADKESCLTPKLDGVKEKALVSSVRQRMKCSSMQKFGERAFKAWAVARLSQTFPN ADFAEITKLATDLTKVNKECCHGDLLECADDRAELAKYMCENQATISSKLQTCCDKPLLKKAHCLSEVEHDTMPAD LPAIAADFVEDQEVCKNYAEAKDVFLGTFLYEYSRRHPDYSVSLLLRLAKKYEATLEKCCAEANPPACYGTVLAEFQP LVEEPKNLVKTNCDLYEKLGEYGFQNAILVRYTQKAPQVSTPTLVEAARNLGRVGTKCCTLPEDQRLPCVEDYLSAIL NRVCLLHEKTPVSEHVTKCCSGSLVERRPCFSALTVDETYVPKEFKAETFTFHSDICTLPEKEKQIKKQTALAELVKHK PKATAEQLKTVMDDFAQFLDTCCKAADKDTCFSTEGPNLVTRCKDALAHHHHHH |
| SEQ ID NO: 234 | 6706-VH/CH1-MSA-DNA | CAGGTGCAATTGGTGGAAAGCGGCGGCGGCCTGGTGCAACCGGGCGGCAGCCTGCGTCTGAGCTGCGCGGC CTCCGGATTTACCTTTTCTGATTATGCTATTCATTGGGTGCGCCAAGCCCCTGGGAAGGGTCTCGAGTGGGTG AGCGGTATCTCTTATTCTGGTAGCTCTACCCATTATGCGGATAGCGTGAAAGGCCGTTTTACCATTTCACGTGA TAATTCGAAAAACACCCTGTATCTGCAAATGAACAGCCTGCGTGCGGAAGATACGGCCGTGTATTATTGCGCG CGTGGTTCTCATGGTAATATTATGGCTAAGCGTTATTTTGATTTTTGGGGCCAAGGCACCCTGGTGACGGTTA GCTCAGCTAGCACCAAGGGCCCCAGCGTGTTCCCCCTGGCCCCCAGCAGCAAGAGCACCTCTGGCGGCACTG CTGCCCTGGGCTGCCTGGTCAAGGACTACTTCCCCGAGCCCGTGACAGTGTCCTGGAACAGCGGAGCCCTGA CCTCCGGCGTGCACACCTTCCCCGCCGTGCTGCAGAGCAGCGGCCTGTACAGCCTGAGCAGCGTGGTCACAG TGCCCAGCAGCAGCCTGGGCACCCAGACCTACATCTGCAACGTGAACCACAAGCCCAGCAACACCAAGGTCG ACAAGAAGGTGGAGCCCAAGAGCTGCGACAAGACCCACACCGAGGCCCACAAGAGCGAGATCGCCCACCGG TACAACGACCTGGGAGAGCAGCATTTCAAGGGACTGGTGCTGATCGCCTTCAGCCAGTACCTGCAGAAGTGC AGCTACGACGAGCACGCCAAGCTGGTGCAGGAAGTGACCGACTTCGCCAAGACCTGCGTGGCCGACGAGAG CGCCGCCAACTGCGACAAGAGCCTGCACACCCTGTTCGGCGACAAGCTGTGCGCCATCCCCAACCTGCGGGA GAACTACGGCGAGCTGGCCGACTGCTGCACCAAGCAGGAACCCGAGCGGAACGAGTGCTTCCTGCAGCACA AGGACGACAACCCCAGCCTGCCCCCCTTCGAGAGGCCTGAGGCCGAGGCCATGTGCACCAGCTTCAAAGAGA ACCCCACCACCTTCATGGGCCACTACCTGCACGAGGTGGCCAGGCGGCACCCCTACTTCTACGCCCCCGAGCT GCTGTACTACGCCGAGCAGTACAACGAGATCCTGACCCAGTGCTGCGCCGAGGCCGACAAAGAGAGCTGCCT GACCCCCAAGCTGGACGGCGTGAAAGAAAAGGCCCTGGTGTCCAGCGTGCGGCAGCGGATGAAGTGCAGCA GCATGCAGAAGTTCGGCGAGCGGGCCTTCAAGGCCTGGGCCGTGGCCCGGCTGTCCCAGACCTTCCCCAACG CCGATTTCGCCGAGATCACCAAGCTGGCCACCGACCTGACCAAGGTGAACAAAGAGTGCTGTCACGGCGACC TGCTGGAATGCGCCGACGACCGGGCCGAGCTGGCCAAGTACATGTGCGAGAACCAGGCCACCATCAGCTCCA |

TABLE 2-continued

| Examples of LRP6 constructs | | |
|---|---|---|
| SEQ ID NUMBER | Construct | Sequence |
| | | AACTGCAGACCTGCTGTGATAAGCCCCTGCTGAAGAAGGCCCACTGCCTGAGCGAGGTGGAGCACGACACCA TGCCCGCCGACCTGCCCGCCATTGCCGCCGACTTCGTGGAGGACCAGGAAGTGTGCAAGAATTACGCCGAGG CCAAGGACGTGTTCCTGGGCACCTTCCTGTACGAGTACAGCAGACGGCACCCCGACTACAGCGTGAGCCTGC TGCTGAGGCTGGCCAAGAAGTACGAGGCCACCCTGGAAAAGTGTTGCGCCGAAGCCAACCCCCCTGCCTGCT ACGGCACCGTGCTGGCCGAGTTCCAGCCCCTGGTGGAGGAACCCAAGAACCTGGTGAAAACCAACTGCGATC TGTACGAGAAGCTGGGCGAGTACGGCTTCCAGAACGCCATCCTGGTCCGGTACACCCAGAAAGCCCCCCAGG TGTCCACCCCCACACTGGTGGAGGCCGCCAGGAACCTGGGCAGAGTCGGCACCAAGTGCTGCACCCTGCCCG AGGATCAGAGGCTGCCCTGTGTCGAGGACTACCTGAGCGCCATCCTGAACAGAGTGTGCCTGCTGCACGAGA AAACCCCCGTGAGCGAGCACGTGACCAAGTGTTGCAGCGGCAGCCTGGTGGAGCGGAGGCCCTGCTTCAGC GCCCTGACCGTGGACGAGACATACGTGCCCAAAGAGTTCAAGGCCGAGACATTCACCTTCCACAGCGACATC TGTACCCTGCCTGAGAAAGAGAAGCAGATCAAGAAGCAGACCGCCCTGGCCGAACTGGTGAAGCACAAGCC CAAGGCCACCGCCGAGCAGCTGAAAACCGTGATGGACGACTTCGCCCAGTTCCTGGACACCTGCTGCAAGGC CGCCGACAAGGACACCTGTTTCAGCACCGAGGGCCCCAACCTGGTGACCCGGTGCAAGGACGCCCTGGCCCA CCATCATCACCATCAC |
| anti-LRP6 MOR06475 Fab-MSA | | |
| SEQ ID NO: 235 | 6475-VL/CL | divltqspatlslspgeratlscrasqfigsrylawyqqkpgqaprlliygasnratgvparfsgsgsgtdftltisslepedfatyycqqyydypqtf gqgtkveikrtvaapsvfifppsdeqlksgtasvvcllnnfypreakvqwkvdnalqsgnsqesvteqdskdstyslsstltlskadyekhkvy acevthqglsspvtksfnrgec |
| SEQ ID NO: 236 | 6475-VL/CL DNA | gatatcgtgctgacccagagcccggcgaccctgagcctgtctccgggcgaacgtgcgaccctgagctgcagagcgagccagtttattggttctcg ttatctggcttggtaccagcagaaaccaggtcaagcaccgcgtctattaatttatggtgcttctaatcgtgcaactggggtcccggcgcgttttagc ggctctggatccggcacggatttaccctgaccattagcagcctggaacctgaagactttgcgacttattattgccagcagtattatgattatcctc agacctttggccagggtacgaaagttgaaattaaacgtacggtggccgctcccagcgtgttcatcttccccccagcgacgagcagctgaagag cggcaccgccagcgtggtgtgcctgctgaacaacttctacccccgggaggccaaggtgcagtggaaggtggacaacgccctgcagagcggcaa cagccaggagagcgtcaccgagcaggacagcaaggactccacctacagcctgagcagcaccctgaccctgagcaaggccgactacgagaag cataaggtgtacgcctgcgaggtgacccaccagggcctgtccagccccgtgaccaagagcttcaacaggggcgagtgc |
| SEQ ID NO: 237 | 6475-VH/CH1-MSA | qvqlkesgpalvkptqtltltctfsgfslsnrgggvgwirqppgkalewlawidwdddksystslktrltiskdtsknqvvltmtnmdpvdtaty ycarmhlplvfdswgqgtlvtvssastkgpsvfplapsskstsggtaalgclvkdyfpepvtvswnsgaltsgvhtfpavlqssglyslssvvtvp ssslgtqtyicnvnhkpsntkvdkrvepkscdkthteahkseiahryndlgeqhfkglvliafsqylqkcsydehaklvqevtdfaktevades aancdkslhtlfgdklcaipnlrenygeladcctkqepernecflqhkddnpslppferpeaeamctsfkenpttfmghylhevarrhpyfy apellyyaeqyneiltqccaeadkescltpkldgvkekalvssvrqrmkcssmqkfgerafkawavarlsqtfpnadfaeitklatdltkvnke cchgdllecaddraelakymcenqatissklqtccdkpllkkahclsevehdtmpadlpaiaadfvedqevcknyaeakdvflgtflyeysrr hpdysvslllrlakkyeatlekccaeanppacygtvlaefqplveepknlvktncdlyeklgeygfqnailvrytqkapqvstptlveaarnlgrv gtkcctlpedqrlpcvedylsailnrvcllhektpvsehvtkccsgslverrpcfsaltvdetyvpkefkaetftfhsdictlpekekqikkqtalael vkhkpkataeqlktvmddfaqfldtcckaadkdtcfstegpnlvtrckdalahhhhhh |
| SEQ ID NO: 238 | 6475-VH/CH1-MSA-DNA | caggtgcaattgaaagaaagcggcccggccctggtgaaaccgacccaaaccctgaccctgacctgtaccttttccggatttagcctgtctaatcg tggtggtggtgtgggttggattcgccagccgcctgggaaagccctcgagtggctggcttggatcgattgggatgatgataagtcttatagcacca gcctgaaaacgcgtctgaccattagcaaagatacttcgaaaaatcaggtggtgctgactatgaccaacatggacccggtggatacggccaccta ttattgcgcgcgtatgcatcttcctcttgtttttgattcttggggccaaggcaccctggtgacggttagctcagctagcaccaagggccccagcgtg ttccccctggcccccagcagcaagagcaccagcggcggcacagccgccctgggctgcctggtgaaggactacttccccgagcccgtgaccgtgt cctggaacagcggagccctgacctccggcgtgcacaccttccccgccgtgctgcagagcagcggcctgtacagcctgtccagcgtggtgacagt gcccagcagcagcctgggcacccagacctacatctgcaacgtgaaccacaagcccagcaacaccaaggtggacaagagagtggagcccaag |

TABLE 2-continued

Examples of LRP6 constructs

| SEQ ID NUMBER | Construct | Sequence |
|---|---|---|
| | | agctgcgacaagacccacaccgaggcccacaagagcgagatcgcccaccggtacaacgacctgggagagcagcatttcaagggactggtgct<br>gatcgccttcagccagtacctgcagaagtgcagctacgacgagcacgccaagctggtgcaggaagtgaccgacttcgccaagacctgcgtggc<br>cgacgagagcgccgccaactgcgacaagagcctgcacaccctgttcggcgacaagctgtgcgccatccccaacctgcgggagaactacggcg<br>agctggccgactgctgcaccaagcaggaacccgagcggaacgagtgcttcctgcagcacaaggacgacaaccccagcctgccccccttcgaga<br>ggcctgaggccgaggccatgtgcaccagcttcaaagagaaccccaccaccttcatgggccactacctgcacgaggtggccaggcggcacccct<br>acttctacgcccccgagctgctgtactacgccgagcagtacaacgagatcctgacccagtgctgcgccgaggccgacaaagagagctgcctga<br>cccccaagctggacggcgtgaaagaaaaggccctggtgtccagcgtgcggcagcggatgaagtgcagcagcatgcagaagttcggcgagcgg<br>gccttcaaggcctgggccgtggcccggctgtcccagaccttccccaacgccgatttcgccgagatcaccaagctggccaccgacctgaccaagg<br>tgaacaaagagtgctgtcacggcgacctgctggaatgcgccgacgaccgggccgagctggccaagtacatgtgcgagaaccaggccaccatc<br>agctccaaactgcagacctgctgtgataagcccctgctgaagaaggcccactgcctgagcgaggtggagcacgacaccatgcccgccgacctg<br>cccgccattgccgccgacttcgtggaggaccaggaagtgtgcaagaattacgccgaggccaaggacgtgttcctgggcaccttcctgtacgagt<br>acagcagacggcaccccgactacagcgtgagcctgctgctgaggctggccaagaagtacgaggccaccctggaaaagtgttgcgccgaagcc<br>aaccccccctgcctgctacggcaccgtgctggccgagttccagcccctggtggaggaacccaagaacctggtgaaaaccaactgcgatctgtacg<br>agaagctgggcgagtacggcttccagaacgccatcctggtccggtacacccagaaagccccccaggtgtccacccccacactggtggaggccg<br>ccaggaacctgggcagagtcggcaccaagtgctgcaccctgcccgaggatcagaggctgccctgtgtcgaggactacctgagcgccatcctga<br>acagagtgtgcctgctgcacgagaaaacccccgtgagcgagcacgtgaccaagtgttgcagcggcagcctggtggagcggaggccctgcttca<br>gcgccctgaccgtggacgagacatacgtgcccaaagagttcaaggccgagacattcaccttccacagcgacatctgtaccctgcctgagaaag<br>agaagcagatcaagaagcagaccgccctggccgaactggtgaagcacaagcccaaggccaccgccgagcagctgaaaaccgtgatggacga<br>cttcgcccagttcctggacacctgctgcaaggccgccgacaaggacacctgtttcagcaccgagggccccaacctggtgacccggtgcaaggac<br>gccctggcccaccatcatcaccatcac |
| Anti-LRP6 MOR06475 scFv-MSA | | |
| SEQ ID NO: 239 | 6475-scFv-MSA | divltqspatlslspgeratlscrasqfigsrylawyqqkpgqaprlliygasnratgvparfsgsgsgtdftltisslepedfatyycqqyydypqtf<br>gqgtkveikggggsggggsggggsggggsqvqlkesgpalvkptqtltltctfsgfslsnrgggvgwirqppgkalewlawidwdddksystsl<br>ktrltiskdtsknqvvltmtnmdpvdtatyycarmhlplvfdswgqgtlvtvssggggsggggseahkseiahryndlgeqhfkglvliafsqy<br>lqkcsydehaklvqevtdfaktcvadesaancdkslhtlfgdklcaipnlrenygeladcctkqepernecflqhkddnpslppferpeaea<br>mctsfkenpttfmghylhevarrhpyfyapellyyaeqyneiltqccaeadkescltpkldgvkekalvssvrqrmkcssmqkfgerafkaw<br>avarlsqtfpnadfaeitklatdltkvnkecchgdllecaddraelakymcenqatissklqtccdkpllkkahclsevehdtmpadlpaiaad<br>fvedqevcknyaeakdvflgtflyeysrrhpdysvslllrlakkyeatlekccaeanppacygtvlaefqplveepknlvktncdlyeklgeygf<br>qnailvrytqkapqvstptlveaarnlgrvgtkcctlpedqrlpcvedylsailnrvcllhektpvsehvtkccsgslverrpcfsaltvdetyvpke<br>fkaetftfhsdictlpekekqikkqtalaelvkhkpkataeqlktvmddfaqfldtcckaadkdtcfstegpnlvtrckdalahhhhhh |
| SEQ ID NO: 240 | 6475-scFv-MSADNA | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>taccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc<br>cgtggacaccgccacctattattgcgcccggatgcatctgcccctggtgttcgatagctggggccagggaaccctggtgacagtgtccagcggcg<br>gaggcggatccgggggtggcggaagtgaggcccacaagagcgagatcgcccaccggtacaacgacctgggagagcagcatttcaagggact<br>ggtgctgatcgccttcagccagtacctgcagaagtgcagctacgacgagcacgccaagctggtgcaggaagtgaccgacttcgccaagacctg<br>cgtggccgacgagagcgccgccaactgcgacaagagcctgcacaccctgttcggcgacaagctgtgcgccatccccaacctgcgggagaacta<br>cggcgagctggccgactgctgcaccaagcaggaacccgagcggaacgagtgcttcctgcagcacaaggacgacaaccccagcctgccccccctt<br>cgagaggcctgaggccgaggccatgtgcaccagcttcaaagagaaccccaccaccttcatgggccactacctgcacgaggtggccaggcggca |

TABLE 2-continued

Examples of LRP6 constructs

| SEQ ID NUMBER | Construct | Sequence |
|---|---|---|
| | | cccctacttctacgcccccgagctgctgtactacgccgagcagtacaacgagatcctgacccagtgctgcgccgaggccgacaaagagagctgc ctgacccccaagctggacggcgtgaaagaaaaggccctggtgtccagcgtgcggcagcggatgaagtgcagcagcatgcagaagttcggcga gcgggccttcaaggcctgggccgtggcccggctgtcccagaccttccccaacgccgatttcgccgagatcaccaagctggccaccgacctgacc aaggtgaacaaagagtgctgtcacggcgacctgctggaatgcgccgacgaccgggccgagctggccaagtacatgtgcgagaaccaggccac catcagctccaaactgcagacctgctgtgataagcccctgctgaagaaggcccactgcctgagcgaggtggagcacgacaccatgcccgccga cctgcccgccattgccgccgacttcgtggaggaccaggaagtgtgcaagaattacgccgaggccaaggacgtgttcctgggcaccttcctgtac gagtacagcagacggcaccccgactacagcgtgagcctgctgctgaggctggccaagaagtacgaggccaccctggaaaagtgttgcgccga agccaacccccctgcctgctacggcaccgtgctggccgagttccagcccctggtggaggaacccaagaacctggtgaaaaccaactgcgatctg tacgagaagctgggcgagtacggcttccagaacgccatcctggtccggtacacccagaaagcccccccaggtgtccacccccacactggtggag gccgccaggaacctgggcagagtcggcaccaagtgctgcaccctgcccgaggatcagaggctgccctgtgtcgaggactacctgagcgccatc ctgaacagagtgtgcctgctgcacgagaaaaccccgtgagcgagcacgtgaccaagtgttgcagcggcagcctggtggagcggaggccctgc ttcagcgccctgaccgtggacgagacatacgtgcccaaagagttcaaggccgagacattcaccttccacagcgacatctgtaccctgcctgaga aagagaagcagatcaagaagcagaccgccctggccgaactggtgaagcacaagcccaaggccaccgccgagcagctgaaaaccgtgatgga cgacttcgcccagttcctggacacctgctgcaaggccgccgacaaggacacctgtttcagcaccgagggccccaacctggtgacccggtgcaag gacgccctggcccaccatcatcaccatcac |
| anti-LRP6_MOR08168 Fab-MSA (C:S) MOR006475-scFv | | |
| SEQ ID NO: 241 | 8168-VL/CL | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |
| SEQ ID NO: 242 | 8168-VL/CL-DNA | GACATCGAGCTGACCCAGCCCCCTTCTGTGTCTGTGGCCCCTGGCCAGACCGCCAGAATCAGCTGCAGCGGC GACAGCCTGCGGAACAAGGTGTACTGGTATCAGCAGAAGCCCGGCCAGGCTCCCGTGCTGGTGATCTACAAG AACAACCGGCCCAGCGGCATCCCTGAGCGGTTCAGCGGCAGCAACAGCGGCAATACCGCCACCCTGACCATC AGCGGCACCCAGGCCGAAGATGAGGCCGACTACTACTGCCAGAGCTACGACGGCCAGAAAAGCCTGGTGTT CGGCGGAGGCACCAAGCTTACCGTGCTGGGCCAGCCCAAAGCCGCCCCTAGCGTGACCCTGTTCCCCCCCAG CAGCGAGGAACTGCAGGCCAACAAGGCCACCCTGGTCTGCCTGATCAGCGACTTCTACCCTGGCGCCGTGAC CGTGGCCTGGAAGGCCGACAGCAGCCCCGTGAAGGCCGGCGTGGAGACAACCACCCCCAGCAAGCAGAGCA ACAACAAGTACGCCGCCAGCAGCTACCTGAGCCTGACCCCCGAGCAGTGGAAGAGCCACAGAAGCTACAGCT GCCAGGTCACCCACGAGGGCAGCACCGTGGAGAAAACCGTGGCCCCCACCGAGTGCAGC |
| SEQ ID NO: 243 | 8168-VH/CH1-MSA-(C:S)-6475-scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKKVEPKS CDKTHTEAHKSEIAHRYNDLGEQHFKGLVLIAFSQYLQKSSYDEHAKLVQEVTDFAKTCVADESAANCDKSLHTLFG DKLCAIPNLRENYGELADCCTKQEPERNECFLQHKDDNPSLPPFERPEAEAMCTSFKENPTTFMGHYLHEVARRHP YFYAPELLYYAEQYNEILTQCCAEADKESCLTPKLDGVKEKALVSSVRQRMKCSSMQKFGERAFKAWAVARLSQTF PNADFAEITKLATDLTKVNKECCHGDLLECADDRAELAKYMCENQATISSKLQTCCDKPLLKKAHCLSEVEHDTMP ADLPAIAADFVEDQEVCKNYAEAKDVFLGTFLYEYSRRHPDYSVSLLLRLAKKYEATLEKCCAEANPPACYGTVLAEF QPLVEEPKNLVKTNCDLYEKLGEYGFQNAILVRYTQKAPQVSTPTLVEAARNLGRVGTKCCTLPEDQRLPCVEDYLS AILNRVCLLHEKTPVSEHVTKCCSGSLVERRPCFSALTVDETYVPKEFKAETFTFHSDICTLPEKEKQIKKQTALAELVK HKPKATAEQLKTVMDDFAQFLDTCCKAADKDTCFSTEGPNLVTRSKDALAGGSGGSDIVLTQSPATLSLSPGERAT |

TABLE 2-continued

| Examples of LRP6 constructs | | |
|---|---|---|
| SEQ ID NUMBER | Construct | Sequence |
| | | LSCRASQFIGSRYLAWYQQKPGQAPRLLIYGASNRATGVPARFSGSGSGTDFTLTISSLEPEDFATYYCQQYYDYPQ<br>TFGQGTKVEIKGGGGSGGGGSGGGGSGGGGSQVQLKESGPALVKPTQTLTLTCTFSGFSLSNRGGGVGWIRQPP<br>GKALEWLAWIDWDDDKSYSTSLKTRLTISKDTSKNQVVLTMTNMDPVDTATYYCARMHLPLVFDSWGQGTLVT<br>VSS |
| SEQ ID NO: 244 | 8168-VH/CH1-MSA-(C:S)-6475-scFv-DNA | CAGGTGCAATTGGTCGAGTCTGGCGGAGGACTGGTGCAGCCTGGTGGCAGCCTGAGACTGAGCTGCGCCGC<br>CAGCGGCTTCACCTTCAGCGACTACGTGATCAACTGGGTGCGACAGGCCCCTGGAAAGGGCCTGGAATGGGT<br>GTCCGGCATCTCTTGGTCTGGCGTGAACACCCACTACGCCGACAGCGTGAAGGGCCGGTTCACCATCAGCCG<br>GGACAACAGCAAGAACACCCTGTACCTGCAGATGAACAGCCTGAGAGCCGAGGACACCGCCGTGTACTACTG<br>TGCCAGACTGGGCGCCACCGCCAACAACATCCGGTACAAGTTCATGGACGTGTGGGGCCAGGGCACACTTGT<br>GACCGTCAGCTCAGCTAGCACCAAGGGCCCCAGCGTGTTCCCCCTGGCCCCCAGCAGCAAGAGCACCTCTGG<br>CGGCACTGCTGCCCTGGGCTGCCTGGTCAAGGACTACTTCCCCGAGCCCGTGACAGTGTCCTGGAACAGCGG<br>AGCCCTGACCTCCGGCGTGCACACCTTCCCCGCCGTGCTGCAGAGCAGCGGCCTGTACAGCCTGAGCAGCGT<br>GGTCACAGTGCCCAGCAGCAGCCTGGGCACCCAGACCTACATCTGCAACGTGAACCACAAGCCCAGCAACAC<br>CAAGGTCGACAAGAAGGTGGAGCCCAAGAGCTGCGACAAGACCCACACCGAGGCCCACAAGAGCGAGATCG<br>CCCACCGGTACAACGACCTGGGAGAGCAGCATTTCAAGGGACTGGTGCTGATCGCCTTCAGCCAGTACCTGC<br>AGAAGTCCAGCTACGACGAGCACGCCAAGCTGGTGCAGGAAGTGACCGACTTCGCCAAGACCTGCGTGGCC<br>GACGAGAGCGCCGCCAACTGCGACAAGAGCCTGCACACCCTGTTCGGCGACAAGCTGTGCGCCATCCCCAAC<br>CTGCGGGAGAACTACGGCGAGCTGGCCGACTGCTGCACCAAGCAGGAACCCGAGCGGAACGAGTGCTTCCT<br>GCAGCACAAGGACGACAACCCCAGCCTGCCCCCCTTCGAGAGGCCTGAGGCCGAGGCCATGTGCACCAGCTT<br>CAAAGAGAACCCCACCACCTTCATGGGCCACTACCTGCACGAGGTGGCCAGGCGGCACCCCTACTTCTACGCC<br>CCCGAGCTGCTGTACTACGCCGAGCAGTACAACGAGATCCTGACCCAGTGCTGCGCCGAGGCCGACAAAGAG<br>AGCTGCCTGACCCCCAAGCTGGACGGCGTGAAAGAAAAGGCCCTGGTGTCCAGCGTGCGGCAGCGGATGAA<br>GTGCAGCAGCATGCAGAAGTTCGGCGAGCGGGCCTTCAAGGCCTGGGCCGTGGCCCGGCTGTCCCAGACCTT<br>CCCCAACGCCGATTTCGCCGAGATCACCAAGCTGGCCACCGACCTGACCAAGGTGAACAAAGAGTGCTGTCA<br>CGGCGACCTGCTGGAATGCGCCGACGACCGGGCCGAGCTGGCCAAGTACATGTGCGAGAACCAGGCCACCA<br>TCAGCTCCAAACTGCAGACCTGCTGTGATAAGCCCCTGCTGAAGAAGGCCCACTGCCTGAGCGAGGTGGAGC<br>ACGACACCATGCCCGCCGACCTGCCCGCCATTGCCGCCGACTTCGTGGAGGACCAGGAAGTGTGCAAGAATT<br>ACGCCGAGGCCAAGGACGTGTTCCTGGGCACCTTCCTGTACGAGTACAGCAGACGGCACCCCGACTACAGCG<br>TGAGCCTGCTGCTGAGGCTGGCCAAGAAGTACGAGGCCACCCTGGAAAAGTGTTGCGCCGAAGCCAACCCCC<br>CTGCCTGCTACGGCACCGTGCTGGCCGAGTTCCAGCCCCTGGTGGAGGAACCCAAGAACCTGGTGAAAACCA<br>ACTGCGATCTGTACGAGAAGCTGGGCGAGTACGGCTTCCAGAACGCCATCCTGGTCCGGTACACCCAGAAAG<br>CCCCCCAGGTGTCCACCCCCACACTGGTGGAGGCCGCCAGGAACCTGGGCAGAGTCGGCACCAAGTGCTGCA<br>CCCTGCCCGAGGATCAGAGGCTGCCCTGTGTCGAGGACTACCTGAGCGCCATCCTGAACAGAGTGTGCCTGC<br>TGCACGAGAAAACCCCCGTGAGCGAGCACGTGACCAAGTGTTGCAGCGGCAGCCTGGTGGAGCGGAGGCCC<br>TGCTTCAGCGCCCTGACCGTGGACGAGACATACGTGCCCAAAGAGTTCAAGGCCGAGACATTCACCTTCCACA<br>GCGACATCTGTACCCTGCCTGAGAAAGAGAAGCAGATCAAGAAGCAGACCGCCCTGGCCGAACTGGTGAAG<br>CACAAGCCCAAGGCCACCGCCGAGCAGCTGAAAACCGTGATGGACGACTTCGCCCAGTTCCTGGACACCTGC<br>TGCAAGGCCGCCGACAAGGACACCTGTTTCAGCACCGAGGGCCCCAACCTGGTGACCCGGTCCAAGGACGCC<br>CTGGCCGGCGGCTCCGGCGGAAGCGATATCGTGCTGACACAGAGCCCTGCCACCCTGTCTCTGAGCCCTGGC<br>GAGAGAGCCACCCTGAGCTGCCGGGCCAGCCAGTTCATCGGCTCCCGCTACCTGGCCTGGTATCAGCAGAAG<br>CCCGGACAGGCTCCCAGACTGCTGATCTACGGCGCCAGCAACAGAGCTACCGGCGTGCCCGCCAGATTTTCT<br>GGCAGCGGCAGCGGCACCGACTTCACCCTGACCATCAGCAGCCTGGAACCCGAGGACTTCGCCACCTACTAC<br>TGCCAGCAGTACTACGACTACCCCCAGACCTTCGGCCAGGGCACCAAGGTGGAGATCAAGGGCGGAGGCGG<br>ATCCGGGGGTGGCGGAAGTGGAGGCGGAGGAAGCGGAGGGGGCGGAAGCCAGGTGCAATTGAAAGAGTC<br>CGGCCCTGCCCTGGTGAAGCCTACCCAGACCCTGACCCTGACATGCACCTTCAGCGGCTTCAGCCTGAGCAAC<br>AGAGGCGGCGGAGTGGGCTGGATCAGACAGCCTCCCGGCAAGGCCCTGGAATGGCTGGCCTGGATCGACTG<br>GGACGACGACAAGAGCTACAGCACCAGCCTGAAAACCCGGCTGACCATCTCCAAGGACACCAGCAAGAACCA |

TABLE 2-continued

Examples of LRP6 constructs

| SEQ ID NUMBER | Construct | Sequence |
| --- | --- | --- |
| | | GGTGGTGCTCACCATGACCAACATGGACCCCGTGGACACCGCCACCTATTATTGCGCCCGGATGCATCTGCCC CTGGTGTTCGATAGCTGGGGCCAGGGAACCCTGGTGACAGTGTCCAGC |
| anti-LRP6_MOR08168 Fab-HSA (C:S) MOR06475-scFv | | |
| SEQ ID NO: 245 | 8168-VL/CL | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |
| SEQ ID NO: 246 | 8168-VL/CL-DNA | GACATCGAGCTGACCCAGCCCCCTTCTGTGTCTGTGGCCCCTGGCCAGACCGCCAGAATCAGCTGCAGCGGC GACAGCCTGCGGAACAAGGTGTACTGGTATCAGCAGAAGCCCGGCCAGGCTCCCGTGCTGGTGATCTACAAG AACAACCGGCCCAGCGGCATCCCTGAGCGGTTCAGCGGCAGCAACAGCGGCAATACCGCCACCCTGACCATC AGCGGCACCCAGGCCGAAGATGAGGCCGACTACTACTGCCAGAGCTACGACGGCCAGAAAAGCCTGGTGTT CGGCGGAGGCACCAAGCTTACCGTGCTGGGCCAGCCCAAAGCCGCCCCTAGCGTGACCCTGTTCCCCCCCAG CAGCGAGGAACTGCAGGCCAACAAGGCCACCCTGGTCTGCCTGATCAGCGACTTCTACCCTGGCGCCGTGAC CGTGGCCTGGAAGGCCGACAGCAGCCCCGTGAAGGCCGGCGTGGAGACAACCACCCCCAGCAAGCAGAGCA ACAACAAGTACGCCGCCAGCAGCTACCTGAGCCTGACCCCCGAGCAGTGGAAGAGCCACAGAAGCTACAGCT GCCAGGTCACCCACGAGGGCAGCACCGTGGAGAAAACCGTGGCCCCCACCGAGTGCAGC |
| SEQ ID NO: 247 | 8168-VH/CH1-HSA-(C:S)-6475-scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKKVEPKS CDKTHTDAHKSEVAHRFKDLGEENFKALVLIAFAQYLQQSPFEDHVKLVNEVTEFAKTCVADESAENCDKSLHTLF GDKLCTVATLRETYGEMADCCAKQEPERNECFLQHKDDNPNLPRLVRPEVDVMCTAFHDNEETFLKKYLYEIARR HPYFYAPELLFFAKRYKAAFTECCQAADKAACLLPKLDELRDEGKASSAKQRLKCASLQKFGERAFKAWAVARLSQ RFPKAEFAEVSKLVTDLTKVHTECCHGDLLECADDRADLAKYICENQDSISSKLKECCEKPLLEKSHCIAEVENDEMP ADLPSLAADFVESKDVCKNYAEAKDVFLGMFLYEYARRHPDYSVVLLLRLAKTYETTLEKCCAAADPHECYAKVFDE FKPLVEEPQNLIKQNCELFEQLGEYKFQNALLVRYTKKVPQVSTPTLVEVSRNLGKVGSKCCKHPEAKRMPCAEDYL SVVLNQLCVLHEKTPVSDRVTKCCTESLVNRRPCFSALEVDETYVPKEFNAETFTFHADICTLSEKERQIKKQTALVEL VKHKPKATKEQLKAVMDDFAAFVEKCCKADDKETCFAEEGKKLVAASQAALGLGGSGGSDIVLTQSPATLSLSPGE RATLSCRASQFIGSRYLAWYQQKPGQAPRLLIYGASNRATGVPARFSGSGSGTDFTLTISSLEPEDFATYYCQQYYD YPQTFGQGTKVEIKGGGGSGGGGSGGGGSGGGGSQVQLKESGPALVKPTQTLTLTCTFSGFSLSNRGGGVGWIR QPPGKALEWLAWIDWDDDKSYSTSLKTRLTISKDTSKNQVVLTMTNMDPVDTATYYCARMHLPLVFDSWGQGT LVTVSS |
| SEQ ID NO: 248 | 8168-VH/CH1-HSA-(C:S)-6475-scFv-DNA | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT GACCGTCAGCTCAGCTAGCACCAAGGGCCCCAGCGTGTTCCCCCTGGCCCCCTCCAGCAAGTCCACAAGCGGT GGCACAGCAGCTCTGGGTTGCCTGGTGAAGGACTACTTCCCCGAGCCCGTGACAGTGTCCTGGAACTCTGGC GCCCTGACCTCCGGCGTGCACACCTTCCCCGCCGTGCTGCAGAGCAGCGGCCTGTACAGCCTGAGCAGCGTG |

TABLE 2-continued

| Examples of LRP6 constructs | | |
|---|---|---|
| SEQ ID NUMBER | Construct | Sequence |
| | | GTGACAGTCCCCAGCAGCAGCTTGGGCACCCAGACCTACATCTGCAACGTGAACCACAAGCCCAGCAACACC<br>AAGGTGGACAAGAAGGTGGAGCCCAAGAGCTGCGACAAGACCCACACCGACGCCCACAAGAGCGAGGTGG<br>CCCACCGGTTCAAGGACCTGGGCGAGGAAAACTTCAAGGCCCTGGTGCTGATCGCCTTCGCCCAGTACCTGC<br>AGCAGAGCCCCTTCGAAGATCACGTAAAGTTAGTCAACGAGGTTACGGAATTCGCAAAGACATGCGTTGCTG<br>ACGAATCCGCTGAGAATTGTGACAAGAGTTTGCACACTTTATTCGGAGATAAGTTGTGTACTGTAGCTACTTT<br>GAGAGAGACTTACGGTGAAATGGCTGACTGCTGTGCAAAACAGGAACCAGAACGTAACGAATGTTTCCTTCA<br>GCATAAGGATGATAACCCTAACCTTCCAAGGCTTGTTAGGCCAGAAGTCGACGTGATGTGCACCGCCTTCCAT<br>GATAATGAAGAGACTTTTCTTAAAAAGTACCTATACGAGATTGCAAGGCGTCATCCATATTTTTACGCCCCAGA<br>GCTGTTGTTTTTCGCAAAGAGATACAAAGCTGCATTTACTGAGTGTTGCCAAGCTGCCGACAAGGCCGCTTGT<br>TTGCTACCAAAGTTGGACGAATTGAGAGACGAGGGTAAGGCATCATCTGCCAAGCAGAGATTAAAATGTGCA<br>TCTTTGCAAAAATTTGGAGAGAGAGCTTTTAAGGCATGGGCTGTTGCCCGACTAAGCCAAAGATTCCCAAAAG<br>CCGAATTTGCTGAAGTATCCAAGCTGGTGACTGATTTGACTAAAGTACATACAGAATGTTGCCATGGCGACCT<br>TTTAGAATGTGCTGATGACAGAGCAGATTTGGCTAAGTATATCTGCGAAAATCAAGATTCAATCAGCTCTAAG<br>CTGAAGGAATGTTGCGAGAAACCACTGTTAGAAAAATCGCATTGTATTGCTGAAGTTGAAAATGATGAGATG<br>CCTGCTGACTTGCCTTCTCTTGCCGCTGATTTTGTTGAGTCGAAGGATGTCTGTAAGAATTATGCTGAAGCTAA<br>AGACGTTTTCCTGGGTATGTTCTTATATGAGTACGCAAGACGTCACCCAGATTACTCTGTGGTTCTGCTACTGA<br>GATTGGCTAAAACATACGAGACAACGCTGGAGAAGTGCTGTGCTGCCGCTGACCCTCATGAGTGCTATGCAA<br>AGGTTTTTGATGAATTCAAACCATTGGTTGAAGAGCCTCAAAACTTGATAAAGCAGAACTGTGAGCTGTTTGA<br>GCAATTGGGTGAGTATAAGTTCCAAAATGCCCTGTTGGTGAGATATACAAAAAAGGTACCCCAAGTTTCAACG<br>CCCACTTTAGTTGAAGTGTCCAGAAATCTTGGTAAAGTGGGTAGCAAATGTTGCAAGCATCCAGAAGCCAAG<br>CGAATGCCCTGTGCTGAGGATTATCTGTCCGTCGTGTTGAACCAATTGTGCGTATTACACGAAAAAACCCCAG<br>TCTCTGATAGAGTCACCAAATGTTGCACTGAGTCACTAGTTAATAGAAGGCCTTGTTTTTCCGCTTTGGAAGTT<br>GATGAAACCTACGTGCCTAAGGAATTTAACGCTGAGACCTTTACCTTTCACGCTGACATTTGTACTTTGAGTGA<br>AAAAGAGCGTCAAATCAAAAAGCAAACCGCTCTTGTTGAATTGGTGAAACACAAGCCTAAGGCTACGAAGGA<br>GCAGCTTAAAGCCGTCATGGACGATTTCGCCGCATTTGTTGAAAAATGCTGTAAAGCTGATGACAAGGAAAC<br>ATGTTTCGCTGAAGAGGGAAAGAAATTGGTTGCGGCCAGTCAGGCAGCGCTTGGTTTGGGCGGCTCCGGCG<br>GAAGCGATATCGTGCTGACACAGAGCCCTGCCACCCTGTCTCTGAGCCCTGGCGAGAGAGCCACCCTGAGCT<br>GCCGGGCCAGCCAGTTCATCGGCTCCCGCTACCTGGCCTGGTATCAGCAGAAGCCCGGACAGGCTCCCAGAC<br>TGCTGATCTACGGCGCCAGCAACAGAGCTACCGGCGTGCCCGCCAGATTTTCTGGCAGCGGCAGCGGCACCG<br>ACTTCACCCTGACCATCAGCAGCCTGGAACCCGAGGACTTCGCCACCTACTACTGCCAGCAGTACTACGACTA<br>CCCCCAGACCTTCGGCCAGGGCACCAAGGTGGAGATCAAGGGCGGAGGCGGATCCGGGGGTGGCGGAAGT<br>GGAGGCGGAGGAAGCGGAGGGGGCGGAAGCCAGGTGCAATTGAAAGAGTCCGGCCCTGCCCTGGTGAAGC<br>CTACCCAGACCCTGACCCTGACATGCACCTTCAGCGGCTTCAGCCTGAGCAACAGAGGCGGCGGAGTGGGCT<br>GGATCAGACAGCCTCCCGGCAAGGCCCTGGAATGGCTGGCCTGGATCGACTGGGACGACGACAAGAGCTAC<br>AGCACCAGCCTGAAAACCCGGCTGACCATCTCCAAGGACACCAGCAAGAACCAGGTGGTGCTCACCATGACC<br>AACATGGACCCCGTGGACACCGCCACCTATTATTGCGCCCGGATGCATCTGCCCCTGGTGTTCGATAGCTGGG<br>GCCAGGGAACCCTGGTGACAGTGTCCAGC |
| anti-LRP6_MOR08168 Fab-HSA (C:S) MOR06475-scFab | | |
| SEQ ID NO: 249 | 8168-VL/CL | DIELTQPPSVSVAPGQTARISCSGDSLRNKVYWYQQKPGQAPVLVIYKNNRPSGIPERFSGSNSGNTATLTISGTQA<br>EDEADYYCQSYDGQKSLVFGGGTKLTVLGQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTVEKTVAPTECS |

TABLE 2-continued

| SEQ ID NUMBER | Construct | Sequence |
|---|---|---|
| | | Examples of LRP6 constructs |
| SEQ ID NO: 250 | 8168-VL/CL-DNA | GACATCGAGCTGACCCAGCCCCCTTCTGTGTCTGTGGCCCCTGGCCAGACCGCCAGAATCAGCTGCAGCGGC GACAGCCTGCGGAACAAGGTGTACTGGTATCAGCAGAAGCCCGGCCAGGCTCCCGTGCTGGTGATCTACAAG AACAACCGGCCCAGCGGCATCCCTGAGCGGTTCAGCGGCAGCAACAGCGGCAATACCGCCACCCTGACCATC AGCGGCACCCAGGCCGAAGATGAGGCCGACTACTACTGCCAGAGCTACGACGGCCAGAAAAGCCTGGTGTT CGGCGGAGGCACCAAGCTTACCGTGCTGGGCCAGCCCAAAGCCGCCCCTAGCGTGACCCTGTTCCCCCCCAG CAGCGAGGAACTGCAGGCCAACAAGGCCACCCTGGTCTGCCTGATCAGCGACTTCTACCCTGGCGCCGTGAC CGTGGCCTGGAAGGCCGACAGCAGCCCCGTGAAGGCCGGCGTGGAGACAACCACCCCCAGCAAGCAGAGCA ACAACAAGTACGCCGCCAGCAGCTACCTGAGCCTGACCCCCGAGCAGTGGAAGAGCCACAGAAGCTACAGCT GCCAGGTCACCCACGAGGGCAGCACCGTGGAGAAAACCGTGGCCCCCACCGAGTGCAGC |
| SEQ ID NO: 251 | 8168-VH/CH1-HSA-(C:S)-6475-scFab | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKKVEPKS CDKTHTDAHKSEVAHRFKDLGEENFKALVLIAFAQYLQQSPFEDHVKLVNEVTEFAKTCVADESAENCDKSLHTLF GDKLCTVATLRETYGEMADCCAKQEPERNECFLQHKDDNPNLPRLVRPEVDVMCTAFHDNEETFLKKYLYEIARR HPYFYAPELLFFAKRYKAAFTECCQAADKAACLLPKLDELRDEGKASSAKQRLKCASLQKFGERAFKAWAVARLSQ RFPKAEFAEVSKLVTDLTKVHTECCHGDLLECADDRADLAKYICENQDSISSKLKECCEKPLLEKSHCIAEVENDEMP ADLPSLAADFVESKDVCKNYAEAKDVFLGMFLYEYARRHPDYSVVLLLRLAKTYETTLEKCCAAADPHECYAKVFDE FKPLVEEPQNLIKQNCELFEQLGEYKFQNALLVRYTKKVPQVSTPTLVEVSRNLGKVGSKCCKHPEAKRMPCAEDYL SVVLNQLCVLHEKTPVSDRVTKCCTESLVNRRPCFSALEVDETYVPKEFNAETFTFHADICTLSEKERQIKKQTALVEL VKHKPKATKEQLKAVMDDFAAFVEKCCKADDKETCFAEEGKKLVAASQAALGLGGSGGSDIVLTQSPATLSLSPGE RATLSCRASQFIGSRYLAWYQQKPGQAPRLLIYGASNRATGVPARFSGSGSGTDFTLTISSLEPEDFATYYCQQYYD YPQTFGQGTKVEIKRTVAAPSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGECGGGGSGGGGSGGGGSGGGGSGGGGSGGGG SQVQLKESGPALVKPTQTLTLTCTFSGFSLSNRGGGVGWIRQPPGKALEWLAWIDWDDDKSYSTSLKTRLTISKDT SKNQVVLTMTNMDPVDTATYYCARMHLPLVFDSWGQGTLVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNTKVDKRVEPKSC |
| SEQ ID NO: 252 | 8168-VH/CH1-HSA-(C:S)-6475-scFab-DNA | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT GACCGTCAGCTCAGCTAGCACCAAGGGCCCCAGCGTGTTCCCCCTGGCCCCCTCCAGCAAGTCCACAAGCGGT GGCACAGCAGCTCTGGGTTGCCTGGTGAAGGACTACTTCCCCGAGCCCGTGACAGTGTCCTGGAACTCTGGC GCCCTGACCTCCGGCGTGCACACCTTCCCCGCCGTGCTGCAGAGCAGCGGCCTGTACAGCCTGAGCAGCGTG GTGACAGTCCCCAGCAGCAGCTTGGGCACCCAGACCTACATCTGCAACGTGAACCACAAGCCCAGCAACACC AAGGTGGACAAGAAGGTGGAGCCCAAGAGCTGCGACAAGACCCACACCGACGCCCACAAGAGCGAGGTGG CCCACCGGTTCAAGGACCTGGGCGAGGAAAACTTCAAGGCCCTGGTGCTGATCGCCTTCGCCCAGTACCTGC AGCAGAGCCCCTTCGAAGATCACGTAAAGTTAGTCAACGAGGTTACGGAATTCGCAAAGACATGCGTTGCTG ACGAATCCGCTGAGAATTGTGACAAGAGTTTGCACACTTTATTCGGAGATAAGTTGTGTACTGTAGCTACTTT GAGAGAGACTTACGGTGAAATGGCTGACTGCTGTGCAAAACAGGAACCAGAACGTAACGAATGTTTCCTTCA GCATAAGGATGATAACCCTAACCTTCCAAGGCTTGTTAGGCCAGAAGTCGACGTGATGTGCACCGCCTTCCAT GATAATGAAGAGACTTTTCTTAAAAAGTACCTATACGAGATTGCAAGGCGTCATCCATATTTTTACGCCCCAGA GCTGTTGTTTTTCGCAAAGAGATACAAAGCTGCATTTACTGAGTGTTGCCAAGCTGCCGACAAGGCCGCTTGT TTGCTACCAAAGTTGGACGAATTGAGAGACGAGGGTAAGGCATCATCTGCCAAGCAGAGATTAAAATGTGCA TCTTTGCAAAAATTTGGAGAGAGAGCTTTTAAGGCATGGGCTGTTGCCCGACTAAGCCAAAGATTCCCAAAAG |

TABLE 2-continued

| Examples of LRP6 constructs | | |
|---|---|---|
| SEQ ID NUMBER | Construct | Sequence |
| | | CCGAATTTGCTGAAGTATCCAAGCTGGTGACTGATTTGACTAAAGTACATACAGAATGTTGCCATGGCGACCT<br>TTTAGAATGTGCTGATGACAGAGCAGATTTGGCTAAGTATATCTGCGAAAATCAAGATTCAATCAGCTCTAAG<br>CTGAAGGAATGTTGCGAGAAACCACTGTTAGAAAAATCGCATTGTATTGCTGAAGTTGAAAATGATGAGATG<br>CCTGCTGACTTGCCTTCTCTTGCCGCTGATTTTGTTGAGTCGAAGGATGTCTGTAAGAATTATGCTGAAGCTAA<br>AGACGTTTTCCTGGGTATGTTCTTATATGAGTACGCAAGACGTCACCCAGATTACTCTGTGGTTCTGCTACTGA<br>GATTGGCTAAAACATACGAGACAACGCTGGAGAAGTGCTGTGCTGCCGCTGACCCTCATGAGTGCTATGCAA<br>AGGTTTTTGATGAATTCAAACCATTGGTTGAAGAGCCTCAAAACTTGATAAAGCAGAACTGTGAGCTGTTTGA<br>GCAATTGGGTGAGTATAAGTTCCAAAATGCCCTGTTGGTGAGATATACAAAAAAGGTACCCCAAGTTTCAACG<br>CCCACTTTAGTTGAAGTGTCCAGAAATCTTGGTAAAGTGGGTAGCAAATGTTGCAAGCATCCAGAAGCCAAG<br>CGAATGCCCTGTGCTGAGGATTATCTGTCCGTCGTGTTGAACCAATTGTGCGTATTACACGAAAAAACCCCAG<br>TCTCTGATAGAGTCACCAAATGTTGCACTGAGTCACTAGTTAATAGAAGGCCTTGTTTTTCCGCTTTGGAAGTT<br>GATGAAACCTACGTGCCTAAGGAATTTAACGCTGAGACCTTTACCTTTCACGCTGACATTTGTACTTTGAGTGA<br>AAAAGAGCGTCAAATCAAAAAGCAAACCGCTCTTGTTGAATTGGTGAAACACAAGCCTAAGGCTACGAAGGA<br>GCAGCTTAAAGCCGTCATGGACGATTTCGCCGCATTTGTTGAAAAATGCTGTAAAGCTGATGACAAGGAAAC<br>ATGTTTCGCTGAAGAGGGAAAGAAATTGGTTGCGGCCAGTCAGGCAGCGCTTGGTTTGGGCGGCTCCGGCG<br>GAAGCGATATCGTGCTGACCCAGAGCCCGGCGACCCTGAGCCTGTCTCCGGGCGAACGTGCGACCCTGAGCT<br>GCAGAGCGAGCCAGTTTATTGGTTCTCGTTATCTGGCTTGGTACCAGCAGAAACCAGGTCAAGCACCGCGTCT<br>ATTAATTTATGGTGCTTCTAATCGTGCAACTGGGGTCCCGGCGCGTTTTAGCGGCTCTGGATCCGGCACGGAT<br>TTTACCCTGACCATTAGCAGCCTGGAACCTGAAGACTTTGCGACTTATTATTGCCAGCAGTATTATGATTATCC<br>TCAGACCTTTGGCCAGGGTACGAAAGTTGAAATTAAACGTACGGTGGCCGCTCCCAGCGTGTTCATCTTCCCC<br>CCCAGCGACGAGCAGCTGAAGAGCGGCACCGCCAGCGTGGTGTGCCTGCTGAACAACTTCTACCCCCGGGAG<br>GCCAAGGTGCAGTGGAAGGTGGACAACGCCCTGCAGAGCGGCAACAGCCAGGAGAGCGTCACCGAGCAGG<br>ACAGCAAGGACTCCACCTACAGCCTGAGCAGCACCCTGACCCTGAGCAAGGCCGACTACGAGAAGCATAAGG<br>TGTACGCCTGCGAGGTGACGCACCAGGGCCTGTCCAGCCCCGTGACCAAGAGCTTCAACAGGGGCGAGTGC<br>GGAGGTGGGGGATCGGGAGGAGGTGGGTCAGGTGGAGGAGGGTCAGGGGGAGGGGGCTCGGGAGGCGG<br>TGGCTCCGGAGGGGGTGGGAGCCAAGTGCAATTGAAAGAAAGCGGCCCGGCCCTGGTGAAACCGACCCAAA<br>CCCTGACCCTGACCTGTACCTTTTCCGGATTTAGCCTGTCTAATCGTGGTGGTGGTGTGGGTTGGATTCGCCAG<br>CCGCCTGGGAAAGCCCTCGAGTGGCTGGCTTGGATCGATTGGGATGATGATAAGTCTTATAGCACCAGCCTG<br>AAAACGCGTCTGACCATTAGCAAAGATACTTCGAAAAATCAGGTGGTGCTGACTATGACCAACATGGACCCG<br>GTGGATACGGCCACCTATTATTGCGCGCGTATGCATCTTCCTCTTGTTTTTGATTCTTGGGGCCAAGGCACCCT<br>GGTGACGGTTAGCTCAGCTAGCACCAAGGGCCCCAGCGTGTTCCCCCTGGCCCCCAGCAGCAAGAGCACCAG<br>CGGCGGCACAGCCGCCCTGGGCTGCCTGGTGAAGGACTACTTCCCCGAGCCCGTGACCGTGTCCTGGAACAG<br>CGGAGCCCTGACCTCCGGCGTGCACACCTTCCCCGCCGTGCTGCAGAGCAGCGGCCTGTACAGCCTGTCCAGC<br>GTGGTGACAGTGCCCAGCAGCAGCCTGGGCACCCAGACCTACATCTGCAACGTGAACCACAAGCCCAGCAAC<br>ACCAAGGTGGACAAGAGAGTGGAGCCCAAGAGCTGC |
| anti-LRP6_MOR08168-hIgG1LALA (mut Hinge F:T; Y:D) MOR06475-scFv | | |
| SEQ ID NO: 253 | 8168-VL/CL | DIELTQPPSVSVAPGQTARISCSGDSLRNKVYWYQQKPGQAPVLVIYKNNRPSGIPERFSGSNSGNTATLTISGTQA<br>EDEADYYCQSYDGQKSLVFGGGTKLTVLGQPKAAPSVTLFPPSSEELQANKATLVCLISDFYPGAVTVAWKADSSP<br>VKAGVETTTPSKQSNNKYAASSYLSLTPEQWKSHRSYSCQVTHEGSTVEKTVAPTECS |

TABLE 2-continued

| SEQ ID NUMBER | Construct | Sequence |
|---|---|---|
| Examples of LRP6 constructs | | |
| SEQ ID NO: 254 | 8168-VL/CL-DNA | GACATCGAGCTGACCCAGCCCCCTTCTGTGTCTGTGGCCCCTGGCCAGACCGCCAGAATCAGCTGCAGCGGC GACAGCCTGCGGAACAAGGTGTACTGGTATCAGCAGAAGCCCGGCCAGGCTCCCGTGCTGGTGATCTACAAG AACAACCGGCCCAGCGGCATCCCTGAGCGGTTCAGCGGCAGCAACAGCGGCAATACCGCCACCCTGACCATC AGCGGCACCCAGGCCGAAGATGAGGCCGACTACTACTGCCAGAGCTACGACGGCCAGAAAAGCCTGGTGTT CGGCGGAGGCACCAAGCTTACCGTGCTGGGCCAGCCCAAAGCCGCCCCTAGCGTGACCCTGTTCCCCCCCAG CAGCGAGGAACTGCAGGCCAACAAGGCCACCCTGGTCTGCCTGATCAGCGACTTCTACCCTGGCGCCGTGAC CGTGGCCTGGAAGGCCGACAGCAGCCCCGTGAAGGCCGGCGTGGAGACAACCACCCCCAGCAAGCAGAGCA ACAACAAGTACGCCGCCAGCAGCTACCTGAGCCTGACCCCCGAGCAGTGGAAGAGCCACAGAAGCTACAGCT GCCAGGTCACCCACGAGGGCAGCACCGTGGAGAAAACCGTGGCCCCCACCGAGTGCAGC |
| SEQ ID NO: 255 | 8168-hIgG1LALA-(mut-Hinge-F:T; Y:D)-6475-scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTGPPGPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFTLDSKLTVDKSRWQQGNVFSCSVMHEALHNHYTQKSLSLSP GKGGSGGSDIVLTQSPATLSLSPGERATLSCRASQFIGSRYLAWYQQKPGQAPRLLIYGASNRATGVPARFSGSGSG TDFTLTISSLEPEDFATYYCQQYYDYPQTFGQGTKVEIKGGGGSGGGGSGGGGSGGGGSQVQLKESGPALVKPTQ TLTLTCTFSGFSLSNRGGGVGWIRQPPGKALEWLAWIDWDDDKSYSTSLKTRLTISKDTSKNQVVLTMTNMDPV DTATYYCARMHLPLVFDSWGQGTLVTVSS |
| SEQ ID NO: 256 | 8168-hIgG1LALA-(mut-Hinge-F:T; Y:D)-6475-scFv-DNA | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT GACCGTCAGCTCAGCTAGCACCAAGGGCCCCAGCGTGTTCCCCCTGGCCCCCAGCAGCAAGAGCACCAGCGG CGGCACAGCCGCCCTGGGCTGCCTGGTGAAGGACTACTTCCCCGAGCCCGTGACCGTGTCCTGGAACAGCGG AGCCCTGACCTCCGGCGTGCACACCTTCCCCGCCGTGCTGCAGAGCAGCGGCCTGTACAGCCTGTCCAGCGTG GTGACAGTGCCCAGCAGCAGCCTGGGCACCCAGACCTACATCTGCAACGTGAACCACAAGCCCAGCAACACC AAGGTGGACAAGAGAGTGGAGCCCAAGAGCTGCGACAAGACCCACACCGGCCCCCCCGGCCCAGCCCCAGA GGCAGCGGGCGGACCCTCCGTGTTCCTGTTCCCCCCCAAGCCCAAGGACACCCTGATGATCAGCAGGACCCCC GAGGTGACCTGCGTGGTGGTGGACGTGAGCCACGAGGACCCAGAGGTGAAGTTCAACTGGTACGTGGACGG CGTGGAGGTGCACAACGCCAAGACCAAGCCCAGAGAGGAGCAGTACAACAGCACCTACAGGGTGGTGTCCG TGCTGACCGTGCTGCACCAGGACTGGCTGAACGGCAAGGAATACAAGTGCAAGGTCTCCAACAAGGCCCTGC CAGCCCCCATCGAAAAGACCATCAGCAAGGCCAAGGGCCAGCCACGGGAGCCCCAGGTGTACACCCTGCCCC CCTCCCGGGAGGAGATGACCAAGAACCAGGTGTCCCTGACCTGTCTGGTGAAGGGCTTCTACCCCAGCGACA TCGCCGTGGAGTGGGAGAGCAACGGCCAGCCCGAGAACAACTACAAGACCACCCCCCCAGTGCTGGACAGC GACGGCAGCTTCACCCTGGACAGCAAGCTGACCGTGGACAAGTCCAGGTGGCAGCAGGGCAACGTGTTCAG CTGCAGCGTGATGCACGAAGCGCTGCACAACCACTACACCCAGAAGAGCCTGAGCCTGTCCCCCGGCAAGGG CGGCTCCGGCGGAAGCGATATCGTGCTGACACAGAGCCCTGCCACCCTGTCTCTGAGCCCTGGCGAGAGAGC CACCCTGAGCTGCCGGGCCAGCCAGTTCATCGGCTCCCGCTACCTGGCCTGGTATCAGCAGAAGCCCGGACA GGCTCCCAGACTGCTGATCTACGGCGCCAGCAACAGAGCTACCGGCGTGCCCGCCAGATTTTCTGGCAGCGG CAGCGGCACCGACTTCACCCTGACCATCAGCAGCCTGGAACCCGAGGACTTCGCCACCTACTACTGCCAGCAG TACTACGACTACCCCCAGACCTTCGGCCAGGGCACCAAGGTGGAGATCAAGGGCGGAGGCGGATCCGGGGG TGGCGGAAGTGGAGGCGGAGGAAGCGGAGGGGGCGGAAGCCAGGTGCAATTGAAAGAGTCCGGCCCTGC CCTGGTGAAGCCTACCCAGACCCTGACCCTGACATGCACCTTCAGCGGCTTCAGCCTGAGCAACAGAGGCGG CGGAGTGGGCTGGATCAGACAGCCTCCCGGCAAGGCCCTGGAATGGCTGGCCTGGATCGACTGGGACGACG |

TABLE 2-continued

Examples of LRP6 constructs

| SEQ ID NUMBER | Construct | Sequence |
|---|---|---|
| | | ACAAGAGCTACAGCACCAGCCTGAAAACCCGGCTGACCATCTCCAAGGACACCAGCAAGAACCAGGTGGTGC TCACCATGACCAACATGGACCCCGTGGACACCGCCACCTATTATTGCGCCCGGATGCATCTGCCCCTGGTGTTC GATAGCTGGGGCCAGGGAACCCTGGTGACAGTGTCCAGC |
| anti-LRP6_MOR08168-hIgG1LALA 2(CH2_CH3) (mut Hinge F:T; Y:D) MOR06475-scFv | | |
| SEQ ID NO: 257 | 8168-VL/CL | DIELTQPPSVSVAPGQTARISCSGDSLRNKVYWYQQKPGQAPVLVIYKNNRPSGIPERFSGSNSGNTATLTISGTQA EDEADYYCQSYDGQKSLVFGGGTKLTVLGQPKAAPSVTLFPPSSEELQANKATLVCLISDFYPGAVTVAWKADSSP VKAGVETTTPSKQSNNKYAASSYLSLTPEQWKSHRSYSCQVTHEGSTVEKTVAPTECS |
| SEQ ID NO: 258 | 8168-VL/CL-DNA | GACATCGAGCTGACCCAGCCCCCTTCTGTGTCTGTGGCCCCTGGCCAGACCGCCAGAATCAGCTGCAGCGGC GACAGCCTGCGGAACAAGGTGTACTGGTATCAGCAGAAGCCCGGCCAGGCTCCCGTGCTGGTGATCTACAAG AACAACCGGCCCAGCGGCATCCCTGAGCGGTTCAGCGGCAGCAACAGCGGCAATACCGCCACCCTGACCATC AGCGGCACCCAGGCCGAAGATGAGGCCGACTACTACTGCCAGAGCTACGACGGCCAGAAAAGCCTGGTGTT CGGCGGAGGCACCAAGCTTACCGTGCTGGGCCAGCCCAAAGCCGCCCCTAGCGTGACCCTGTTCCCCCCCAG CAGCGAGGAACTGCAGGCCAACAAGGCCACCCTGGTCTGCCTGATCAGCGACTTCTACCCTGGCGCCGTGAC CGTGGCCTGGAAGGCCGACAGCAGCCCCGTGAAGGCCGGCGTGGAGACAACCACCCCCAGCAAGCAGAGCA ACAACAAGTACGCCGCCAGCAGCTACCTGAGCCTGACCCCCGAGCAGTGGAAGAGCCACAGAAGCTACAGCT GCCAGGTCACCCACGAGGGCAGCACCGTGGAGAAAACCGTGGCCCCCACCGAGTGCAGC |
| SEQ ID NO: 259 | 8168-hIgG1LALA-2(CH2—CH3) (mut-Hinge-F:T; Y:D)-6475-scFv | QVQLVESGGGLVQPGGSLRLSCAASGFTFSDYVINWVRQAPGKGLEWVSGISWSGVNTHYADSVKGRFTISRDN SKNTLYLQMNSLRAEDTAVYYCARLGATANNIRYKFMDVWGQGTLVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKRVEPKS CDKTHTGPPGPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVK GFYPSDIAVEWESNGQPENNYKTTPPVLDSDGSFTLDSKLTVDKSRWQQGNVFSCSVMHEALHNHYTQKSLSLSP GKSPPSPAPEAAGGPSVFLFPPKPKDTLMISRTPEVTCVVVDVSHEDPEVKFNWYVDGVEVHNAKTKPREEQYNS TYRVVSVLTVLHQDWLNGKEYKCKVSNKALPAPIEKTISKAKGQPREPQVYTLPPSREEMTKNQVSLTCLVKGFYPS DIAVEWESNGQPENNYKTTPPVLDSDGSFTLDSKLTVDKSRWQQGNVFSCSVMHEALHNHYTQKSLSLSPGKGG SGGSDIVLTQSPATLSLSPGERATLSCRASQFIGSRYLAWYQQKPGQAPRLLIYGASNRATGVPARFSGSGSGTDFT LTISSLEPEDFATYYCQQYYDYPQTFGQGTKVEIKGGGGSGGGGSGGGGSGGGGSQVQLKESGPALVKPTQTLTLT CTFSGFSLSNRGGGVGWIRQPPGKALEWLAWIDWDDDKSYSTSLKTRLTISKDTSKNQVVLTMTNMDPVDTATY YCARMHLPLVFDSWGQGTLVTVSS |
| SEQ ID NO: 260 | 8168-hIgG1LALA-2(CH2—CH3) (mut-Hinge-F:T; Y:D)-6475-scFv-DNA | CAGGTGCAATTGGTCGAGTCTGGCGGAGGACTGGTGCAGCCTGGTGGCAGCCTGAGACTGAGCTGCGCCGC CAGCGGCTTCACCTTCAGCGACTACGTGATCAACTGGGTGCGACAGGCCCCTGGAAAGGGCCTGGAATGGGT GTCCGGCATCTCTTGGTCTGGCGTGAACACCCACTACGCCGACAGCGTGAAGGGCCGGTTCACCATCAGCCG GGACAACAGCAAGAACACCCTGTACCTGCAGATGAACAGCCTGAGAGCCGAGGACACCGCCGTGTACTACTG TGCCAGACTGGGCGCCACCGCCAACAACATCCGGTACAAGTTCATGGACGTGTGGGGCCAGGGCACACTGGT GACCGTCAGCTCAGCTAGCACCAAGGGCCCCAGCGTGTTCCCCCTGGCCCCCAGCAGCAAGAGCACCAGCGG CGGCACAGCCGCCCTGGGCTGCCTGGTGAAGGACTACTTCCCCGAGCCCGTGACCGTGTCCTGGAACAGCGG |

TABLE 2-continued

Examples of LRP6 constructs

| SEQ ID NUMBER | Construct | Sequence |
|---|---|---|
| | | AGCCCTGACCTCCGGCGTGCACACCTTCCCCGCCGTGCTGCAGAGCAGCGGCCTGTACAGCCTGTCCAGCGTG<br>GTGACAGTGCCCAGCAGCAGCCTGGGCACCCAGACCTACATCTGCAACGTGAACCACAAGCCCAGCAACACC<br>AAGGTGGACAAGAGAGTGGAGCCCAAGAGCTGCGACAAGACCCACACCGGCCCCCCCGGCCCAGCCCCAGA<br>GGCAGCGGGCGGACCCTCCGTGTTCCTGTTCCCCCCAAGCCCAAGGACACCCTGATGATCAGCAGGACCCCC<br>GAGGTGACCTGCGTGGTGGTGGACGTGAGCCACGAGGACCCAGAGGTGAAGTTCAACTGGTACGTGGACGG<br>CGTGGAGGTGCACAACGCCAAGACCAAGCCCAGAGAGGAGCAGTACAACAGCACCTACAGGGTGGTGTCCG<br>TGCTGACCGTGCTGCACCAGGACTGGCTGAACGGCAAGGAATACAAGTGCAAGGTCTCCAACAAGGCCCTGC<br>CAGCCCCCATCGAAAAGACCATCAGCAAGGCCAAGGGCCAGCCACGGGAGCCCCAGGTGTACACCCTGCCCC<br>CCTCCCGGGAGGAGATGACCAAGAACCAGGTGTCCCTGACCTGTCTGGTGAAGGGCTTCTACCCCAGCGACA<br>TCGCCGTGGAGTGGGAGAGCAACGGCCAGCCCGAGAACAACTACAAGACCACCCCCCCAGTGCTGGACAGC<br>GACGGCAGCTTCACCCTGGACAGCAAGCTGACCGTGGACAAGTCCAGGTGGCAGCAGGGCAACGTGTTCAG<br>CTGCAGCGTGATGCACGAAGCGCTGCACAACCACTACACCCAGAAGAGCCTGAGCCTGTCCCCCGGCAAGTC<br>CCCCCCCTCCCCAGCCCCAGAGGCAGCGGGCGGACCCTCCGTGTTCCTGTTCCCCCCAAGCCCAAGGACACC<br>CTGATGATCAGCAGGACCCCCGAGGTGACCTGCGTGGTGGTGGACGTGAGCCACGAGGACCCAGAGGTGAA<br>GTTCAACTGGTACGTGGACGGCGTGGAGGTGCACAACGCCAAGACCAAGCCCAGAGAGGAGCAGTACAACA<br>GCACCTACAGGGTGGTGTCCGTGCTGACCGTGCTGCACCAGGACTGGCTGAACGGCAAGGAATACAAGTGC<br>AAGGTCTCCAACAAGGCCCTGCCAGCCCCCATCGAAAAGACCATCAGCAAGGCCAAGGGCCAGCCACGGGA<br>GCCCCAGGTGTACACCCTGCCCCCCTCCCGGGAGGAGATGACCAAGAACCAGGTGTCCCTGACCTGTCTGGT<br>GAAGGGCTTCTACCCCAGCGACATCGCCGTGGAGTGGGAGAGCAACGGCCAGCCCGAGAACAACTACAAGA<br>CCACCCCCCCAGTGCTGGACAGCGACGGCAGCTTCACCCTGGACAGCAAGCTGACCGTGGACAAGTCCAGGT<br>GGCAGCAGGGCAACGTGTTCAGCTGCAGCGTGATGCACGAAGCCCTGCACAACCACTACACCCAGAAGAGCC<br>TGAGCCTGTCCCCCGGCAAGGGCGGCTCCGGCGGAAGCGATATCGTGCTGACACAGAGCCCTGCCACCCTGT<br>CTCTGAGCCCTGGCGAGAGAGCCACCCTGAGCTGCCGGGCCAGCCAGTTCATCGGCTCCCGCTACCTGGCCT<br>GGTATCAGCAGAAGCCCGGACAGGCTCCCAGACTGCTGATCTACGGCGCCAGCAACAGAGCTACCGGCGTGC<br>CCGCCAGATTTTCTGGCAGCGGCAGCGGCACCGACTTCACCCTGACCATCAGCAGCCTGGAACCCGAGGACTT<br>CGCCACCTACTACTGCCAGCAGTACTACGACTACCCCCAGACCTTCGGCCAGGGCACCAAGGTGGAGATCAA<br>GGGCGGAGGCGGATCCGGGGGTGGCGGAAGTGGAGGCGGAGGAAGCGGAGGGGGCGGAAGCCAGGTGC<br>AATTGAAAGAGTCCGGCCCTGCCCTGGTGAAGCCTACCCAGACCCTGACCCTGACATGCACCTTCAGCGGCTT<br>CAGCCTGAGCAACAGAGGCGGCGGAGTGGGCTGGATCAGACAGCCTCCCGGCAAGGCCCTGGAATGGCTGG<br>CCTGGATCGACTGGGACGACGACAAGAGCTACAGCACCAGCCTGAAAACCCGGCTGACCATCTCCAAGGACA<br>CCAGCAAGAACCAGGTGGTGCTCACCATGACCAACATGGACCCCGTGGACACCGCCACCTATTATTGCGCCCG<br>GATGCATCTGCCCCTGGTGTTCGATAGCTGGGGCCAGGGAACCCTGGTGACAGTGTCCAGC |
| Anti-LRP6 MOR08545-2c Fab for PEG | | |
| SEQ ID NO: 261 | 8545-VL 2c for PEG AA | DIELTQPPSVSVAPGQTARISCSGDNIGSKYVHWYQQKPGQAPVLVIYGDSNRPSGIPERFSGSNSGNTATLTISGT<br>QAEDEADYYCTRTSTPISGVFGGGTKLTVLGQPKAAPSVTLFPPSSEELQANKATLVCLISDFYPGAVTVAWKADSS<br>PVKAGVETTTPSKQSNNKYAASSYLSLTPEQWKSHRSYSCQVTHEGSTVEKTVAPTEAC |

TABLE 2-continued

Examples of LRP6 constructs

| SEQ ID NUMBER | Construct | Sequence |
|---|---|---|
| SEQ ID NO: 262 | 8545-VL 2c for PEG DNA | gatatcgaactgacccagccgccttcagtgagcgttgcaccaggtcagaccgcgcgtatctcgtgtagcggcgataatattggttctaagtatgtt cattggtaccagcagaaacccgggcaggcgccagttcttgtgatttatggtgattctaatcgtccctcaggcatcccggaacgctttagcggatcc aacagcggcaacaccgcgaccctgaccattagcggcactcaggcggaagacgaagcggattattattgcactcgtacttctactcctatttctgg tgtgtttggcggcggcacgaagttaaccgttcttggccagccgaaagccgcaccgagtgtgacgctgtttccgccgagcagcgaagaattgcag gcgaacaaagcgaccctggtgtgcctgattagcgacttttatccgggagccgtgacagtggcctggaaggcagatagcagccccgtcaaggcg ggagtggagaccaccacaccctccaaacaaagcaacaacaagtacgcggccagcagctatctgagcctgacgcctgagcagtggaagtccca cagaagctacagctgccaggtcacgcatgaggggagcaccgtggaaaaaaccgttgcgccgactgaggcctgc |
| SEQ ID NO 263 | 8545-VH 2c for PEG AA | QVQLVESGGGLVQPGGSLRLSCAASGFTFSVNGMHWVRQAPGKGLEWVSVIDGMGHTYYADSVKGRFTISRDN SKNTLYLQMNSLRAEDTAVYYCARYDYIKYGAFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNTKVDKKVEPKSC |
| SEQ ID NO 264 | 8545-VH 2c for PEG DNA | caggtgcaattggtggaaagcggcggcggcctggtgcaaccgggcggcagcctgcgtctgagctgcgcggcctccggatttaccttttctgttaa tggtatgcattgggtgcgccaagcccctgggaagggtctcgagtgggtgagcgttattgatggtatgggtcatacttattatgctgattctgttaag ggtcgttttaccatttcacgtgataattcgaaaaacaccctgtatctgcaaatgaacagcctgcgtgcggaagatacggccgtgtattattgcgcg cgttatgattatattaagtatggtgcttttgatccttggggccaaggcaccctggtgacggttagctcagcgtcgaccaaaggtccaagcgtgtttc cgctggctccgagcagcaaaagcaccagcggcggcacggctgccctgggctgcctggttaaagattatttcccggaaccagtcaccgtgagctg gaacagcggggcgctgaccagcggcgtgcatacctttccggcggtgctgcaaagcagcggcctgtatagcctgagcagcgttgtgaccgtgccg agcagcagcttaggcactcagacctatatttgcaacgtgaaccataaaccgagcaacaccaaagtggataaaaaagtggaaccgaaaagctgc |
| 801 | | |
| SEQ ID NO: 265 | 801 | qvqlvesggglvqpggslrlscaasgftfsdyvinwvrqapgkglewvsgiswsgvnthyadsvkgrftisrdnskntlylqmnslraedtavy ycarlgatannirykfmdvwgqgtlvtvssggggsggggsggggsggggsdieltqppsvsvapgqtariscsgdslrnkvywyqqkpgqap vlviyknnrpsgiperfsgsnsgntatltisgtqaedeadyycqsydgqkslvfgggtkltvlaasdahksevahrfkdlgeenfkalvliafaqyl qqspfedhvklvnevtefaktcvadesaencdkslhtlfgdklctvatlretygemadccakqepernecflqhkddnpnlprlvrpevdv mctafhdneetflkkylyeiarrhpyfyapellffakrykaaftecc qaadkaacllpkldelrdegkassakqrlkcaslqkfgerafkawavar lsqrfpkaefaevsklvtdltkvhtecchgdllecaddradlakyicenqdsissklkeccekpllekshciaevendempadlpslaadfvesk dvcknyaeakdvflgmflyeyarrhpdysvvlllrlaktyettlekccaaadphecyakvfdefkplveepqnlikqncelfeqlgeykfqnall vrytkkvpqvstptlvevsrnlgkvgskcckhpeakrmpcaedylsvvlnqlcvlhektpvsdrvtkccteslvnrrpcfsalevdetyvpkef qaetftfhadictlsekerqikkqtalvelvkhkpkatkeqlkavmddfaafvekcckaddketcfaeegkklvaasqaalglaaaldivltqsp atlslspgeratlscrasqfigsrylawyqqkpgqaprlliygasnratgvparfsgsgsgtdftltisslepedfatyycqqyydypqtfgqgtkve ikggggsggggsggggsggggsqvqlkesgpalvkptqtltltctfsgfslsnrgggvgwirqppgkalewlawidwdddksystslktrltiskd tsknqvvltmtnmdpvdtatyycarmhlplvfdswgqgtlvtvssaaaenlyfqgshhhhhh |
| SEQ ID NO: 266 | 801 DNA | caggttcaattggttgaaagcggtggtggtctggttcagcctggtggtagcctgcgtctgagctgtgcagcaagcggttttacctttagcgattatg tgattaattgggttcgtcaggcaccgggtaaaggtctggaatgggttagcggtattagctggtcaggtgttaatacccattatgcagatagcgtga aaggtcgttttaccattagccgtgataatagcaaaaataccctgtatctgcagatgaatagcctgcgtgcagaagataccgcagtttattattgtg cacgtctgggtgcaaccgcaaataatattcgctataaatttatggatgtgtggggtcagggtacactagttaccgttagcagtggtggtggcggc agcggcggtggcggttccggcggtggtggcagcggtggtggtggtagcgatatcgaactgacccagcctccgagcgttagcgttgcaccgggtc agaccgcacgtattagctgtagcggtgatagtctgcgtaataaagtttattggtatcagcagaaaccgggtcaggctccggttctggttatttata aaaataatcgtccgagcggtattccggaacgttttagcggtagcaatagcggtaataccgcaaccctgaccattagcggcacccaggcagaag atgaagccgattattattgtcagagctatgatggtcagaaaagcctggtttttggtggtggcaccaagcttaccgttctggcggcgagcgacgctc acaagagcgaagtggcacataggttcaaagatctgggcgaagagaactttaaggccctcgtcctgatcgctttcgcacagtacctccagcagtc tccctttgaagatcacgtgaaactggtcaatgaggtgaccgaatttgccaagacatgcgtggctgatgagagtgcagaaaactgtgacaaatca ctgcatactctctttggagataagctgtgcaccgtcgccacactcagagagacttatggggaaatggctgactgttgcgcaaaacaggagcctg aacggaatgagtgtttcctccagcacaaggatgacaacccaaatctgccccgcctcgtgcgacctgaggtcgatgtgatgtgcaccgcctttcat |

TABLE 2-continued

| Examples of LRP6 constructs | | |
|---|---|---|
| SEQ ID NUMBER | Construct | Sequence |
| | | gacaacgaagagacattcctgaagaaatacctgtatgaaattgctcgtaggcacccatacttttatgcccccgagctcctgttctttgcaaagag atacaaagctgccttcactgaatgttgccaggcagctgataaggccgcatgtctcctgcctaaactggacgagctccgggatgaaggtaaggctt ccagcgccaaacagcgcctgaagtgcgcttctctccagaagtttggcgagcgagcattcaaagcctgggctgtggcccgtctcagtcagaggttt ccaaaggcagaatttgctgaggtctcaaaactggtgaccgacctcacaaaggtccatactgagtgttgccacggagatctgctggaatgtgccg acgatagagcagacctcgctaaatatatctgcgagaatcaggattccattagctctaagctgaaagaatgttgcgagaagcccctcctggaaaa gagtcattgtatcgccgaggtggaaaacgacgagatgccagcagatctgccatcactcgctgccgactttgtggaatccaaagatgtctgcaag aattacgcagaggctaaagacgtgttcctggggatgtttctgtatgagtacgcccggcgtcaccccgattatagcgtcgtgctcctgctccgactg gcaaagacctacgaaacaactctggagaaatgttgcgctgccgcagaccctcatgaatgttatgctaaggtgttcgatgagtttaagccactcgt cgaagagccccagaacctgattaaacagaattgcgaactgttcgagcagctcggtgaatacaagtttcagaacgccctgctcgtgcgttatacc aaaaaggtccctcaggtgtctacaccaactctggtggaggtcagtaggaatctgggcaaagtgggatcaaagtgttgcaaacaccccgaggca aagagaatgccttgtgctgaagattacctctccgtcgtgctgaaccagctctgcgtgctgcatgaaaagaccccagtcagcgatcgggtgacaa aatgttgcaccgaatctctggtcaatcgccgaccctgtttcagtgccctcgaagtggacgaaacttatgtgcctaaggagtttcaggctgaaacat tcacctttcacgccgatatctgcactctgtccgagaaagaaaggcagattaagaaacagacagcactggtcgagctcgtgaagcataaaccaa aggctaccaaggagcagctgaaagccgtcatggacgatttcgcagcttttgtggaaaagtgttgcaaagccgacgataaggagacttgtttcgc agaagaggggaaaaagctcgtggctgccagccaggcagctctgggtctggcggcggcgctggatatcgtgctgacacagagccctgccaccct gtctctgagccctggcgagagagccaccctgagctgccgggccagccagttcatcggctcccgctacctggcctggtatcagcagaagcccgga caggctcccagactgctgatctacggcgccagcaacagagctaccggcgtgcccgccagattttctggcagcggcagcggcaccgacttcaccc tgaccatcagcagcctggaacccgaggacttcgccacctactactgccagcagtactacgactacccccagaccttcggccagggcaccaaggt ggagatcaagggcggaggcggaagcgggggtggcggaagtggaggcggaggaagcggagggggcggaagccaggtgcaattgaaagagt ccggccctgccctggtgaagcctacccagaccctgaccctgacatgcaccttcagcggcttcagcctgagcaacagaggcggcggagtgggctg gatcagacagcctcccggcaaggccctggaatggctggcctggatcgactgggacgacgacaagagctacagcaccagcctgaaaacccggc tgaccatctccaaggacaccagcaagaaccaggtggtgctcaccatgaccaacatggaccccgtggacaccgccacctattattgcgcccggat gcatctgcccctggtgttcgatagctggggccagggaaccctggtgacagtgtccagcgcggccgcagagaacctgtattttcagggtagccac catcatcaccatcac |
| 801T | | |
| SEQ ID NO: 267 | 801T | QVQLVESGGGLVQPGGSLRLSCAASGFTFSDYVMNWVRQAPGKGLEWVAGISWSGVNTHYADSVKGRFTISRD NSKNTLYLQMNSLRAEDTAVYYCARLGATANNIRYKFMDVWGQGTLVTVSSGGGGSGGGGSGGGGSGGGGSD IELTQPPSVSVAPGQTARISCSGDSLRNKVYWYQQKPGQAPVLVIYKNNRPSGIPERFSGSNSGNTATLTISGTQAE DEADYYCQSYDGQKSLVFGGGTKLTVLAASDAHKSEVAHRFKDLGEENFKALVLIAFAQYLQQSPFEDHVKLVNEV TEFAKTCVADESAENCDKSLHTLFGDKLCTVATLRETYGEMADCCAKQEPERNECFLQHKDDNPNLPRLVRPEVD VMCTAFHDNEETFLKKYLYEIARRHPYFYAPELLFFAKRYKAAFTECCQAADKAACLLPKLDELRDEGKASSAKQRLK CASLQKFGERAFKAWAVARLSQRFPKAEFAEVSKLVTDLTKVHTECCHGDLLECADDRADLAKYICENQDSISSKLK ECCEKPLLEKSHCIAEVENDEMPADLPSLAADFVESKDVCKNYAEAKDVFLGMFLYEYARRHPDYSVVLLLRLAKTY ETTLEKCCAAADPHECYAKVFDEFKPLVEEPQNLIKQNCELFEQLGEYKFQNALLVRYTKKVPQVSTPTLVEVSRNL GKVGSKCCKHPEAKRMPCAEDYLSVVLNQLCVLHEKTPVSDRVTKCCTESLVNRRPCFSALEVDETYVPKEFQAETF TFHADICTLSEKERQIKKQTALVELVKHKPKATKEQLKAVMDDFAAFVEKCCKADDKETCFAEEGKKLVAASQAAL GLAAALDIVLTQSPATLSLSPGERATLSCRASQFIGSRYLAWYQQKPGQAPRLLIYGASNRATGVPARFSGSGSGTD FTLTISSLEPEDFATYYCQQYYDYPQTFGQGTKVEIKGGGGSGGGGSGGGGSGGGGSQVQLKESGPALVKPTQTL TLTCTFSGFSLSNRGGGVGWIRQPPGKALEWLAWIDWDDDKSYSTSLKTRLTISKDTSKNQVVLTMTNMDPVDT ATYYCARFHLPLVFDSWGQGTLVTVSSAAAENLYFQGSHHHHHH |
| SEQ ID NO: 268 | 801T DNA | caggttcaattggttgaaagcggtggtggtctggttcagcctggtggtagcctgcgtctgagctgtgcagcaagcggttttacctttagcgattatg tgatgaattgggttcgtcaggcaccgggtaaaggtctggaatgggttgccggtattagctggtcaggtgttaatacccattatgcagatagcgtg aaaggtcgttttaccattagccgtgataatagcaaaaataccctgtatctgcagatgaatagcctgcgtgcagaagataccgcagtttattattgt gcacgtctgggtgcaaccgcaaataatattcgctataaatttatggatgtgtggggtcagggtacactagttaccgttagcagtggtggtggcgg cagcggcggtggcggttccggcggtggtggcagcggtggtggtggtagcgatatcgaactgacccagcctccgagcgttagcgttgcaccgggt |

TABLE 2-continued

Examples of LRP6 constructs

| SEQ ID NUMBER | Construct | Sequence |
|---|---|---|
| | | cagaccgcacgtattagctgtagcggtgatagtctgcgtaataaagtttattggtatcagcagaaaccgggtcaggctccggttctggttatttat<br>aaaaataatcgtccgagcggtattccggaacgttttagcggtagcaatagcggtaataccgcaaccctgaccattagcggcacccaggcagaa<br>gatgaagccgattattattgtcagagctatgatggtcagaaaagcctggtttttggtggtggcaccaagcttaccgttctggcggcgagcgacgct<br>cacaagagcgaagtggcacataggttcaaagatctgggcgaagagaactttaaggccctcgtcctgatcgctttcgcacagtacctccagcagt<br>ctccctttgaagatcacgtgaaactggtcaatgaggtgaccgaatttgccaagacatgcgtggctgatgagagtgcagaaaactgtgacaaatc<br>actgcatactctctttggagataagctgtgcaccgtcgccacactcagagagacttatggggaaatggctgactgttgcgcaaaacaggagcct<br>gaacggaatgagtgtttcctccagcacaaggatgacaacccaaatctgccccgcctcgtgcgacctgaggtcgatgtgatgtgcaccgcctttca<br>tgacaacgaagagacattcctgaagaaatacctgtatgaaattgctcgtaggcacccatacttttatgccccgagctcctgttctttgcaaagag<br>atacaaagctgccttcactgaatgttgccaggcagctgataaggccgcatgtctcctgcctaaactggacgagctccgggatgaaggtaaggctt<br>ccagcgccaaacagcgcctgaagtgcgcttctctccagaagtttggcgagcgagcattcaaagcctgggctgtggcccgtctcagtcagaggttt<br>ccaaaggcagaatttgctgaggtctcaaaactggtgaccgacctcacaaaggtccatactgagtgttgccacggagatctgctggaatgtgccg<br>acgatagagcagacctcgctaaatatatctgcgagaatcaggattccattagctctaagctgaaagaatgttgcgagaagcccctcctggaaaa<br>gagtcattgtatcgccgaggtggaaaacgacgagatgccagcagatctgccatcactcgctgccgactttgtggaatccaaagatgtctgcaag<br>aattacgcagaggctaaagacgtgttcctggggatgtttctgtatgagtacgcccggcgtcaccccgattatagcgtcgtgctcctgctccgactg<br>gcaaagacctacgaaacaactctggagaaatgttgcgctgccgcagaccctcatgaatgttatgctaaggtgttcgatgagtttaagccactcgt<br>cgaagagccccagaacctgattaaacagaattgcgaactgttcgagcagctcggtgaatacaagtttcagaacgccctgctcgtgcgttatacc<br>aaaaaggtccctcaggtgtctacaccaactctggtggaggtcagtaggaatctgggcaaagtgggatcaaagtgttgcaaacaccccgaggca<br>aagagaatgccttgtgctgaagattacctctccgtcgtgctgaaccagctctgcgtgctgcatgaaaagaccccagtcagcgatcgggtgacaa<br>aatgttgcaccgaatctctggtcaatcgccgaccctgtttcagtgccctcgaagtggacgaaacttatgtgcctaaggagtttcaggctgaaacat<br>tcacctttcacgccgatatctgcactctgtccgagaaagaaaggcagattaagaaacagacagcactggtcgagctcgtgaagcataaaccaa<br>aggctaccaaggagcagctgaaagccgtcatggacgatttcgcagcttttgtggaaaagtgttgcaaagccgacgataaggagacttgtttcgc<br>agaagaggggaaaaagctcgtggctgccagccaggcagctctgggtctggcggcggcgctggatatcgtgctgacacagagccctgccaccct<br>gtctctgagccctggcgagagagccaccctgagctgccgggccagccagttcatcggctcccgctacctggcctggtatcagcagaagcccgga<br>caggctcccagactgctgatctacggcgccagcaacagagctaccggcgtgcccgccagattttctggcagcggcagcggcaccgacttcaccc<br>tgaccatcagcagcctggaacccgaggacttcgccacctactactgccagcagtactacgactaccccagaccttcggccagggcaccaaggt<br>ggagatcaagggcggaggcggaagcgggggtggcggaagtggaggcggaggaagcggagggggcggaagccaggtgcaattgaaagagt<br>ccggccctgccctggtgaagcctacccagaccctgaccctgacatgcaccttcagcggcttcagcctgagcaacagaggcggcggagtgggctg<br>gatcagacagcctcccggcaaggccctggaatggctggcctggatcgactgggacgacgacaagagctacagcaccagcctgaaaacccggc<br>tgaccatctccaaggacaccagcaagaaccaggtggtgctcaccatgaccaacatggaccccgtggacaccgccacctattattgcgcccggtt<br>tcatctgccccctggtgttcgatagctggggccagggaaccctggtgacagtgtccagcgcggccgcagagaacctgtattttcagggtagccacc<br>atcatcaccatcac |
| 802 | | |
| SEQ ID NO: 269 | 802 | divltqspatlslspgeratlscrasqfigsrylawyqqkpgqaprlliygasnratgvparfsgsgsgtdftltisslepedfatyycqqyydypqtf<br>gqgtkveikggggsggggsggggsggggsqvqlkesgpalvkptqtltltctfsgfslsnrgggvgwirqppgkalewlawidwdddksystsl<br>ktrltiskdtsknqvvltmtnmdpvdtatyycarmhlplvfdswgqgtlvtvssaasdahksevahrfkdlgeenfkalvliafaqylqqspfe<br>dhvklvnevtefaktcvadesaencdkslhtlfgdklctvatlretygemadccakqepernecflqhkddnpnlprlvrpevdvmctafhd<br>neetflkkylyeiarrhpyfyapellffakrykaafteccqaadkaacllpkldelrdegkassakqrlkcaslqkfgerafkawavarlsqrfpka<br>efaevsklvtdltkvhtecchgdllecaddradlakyicenqdsissklkeccekpllekshciaevendempadlpslaadfveskdvcknya<br>eakdvflgmflyeyarrhpdysvvlllrlaktyettlekccaaadphecyakvfdefkplveepqnlikqncelfeqlgeykfqnallvrytkkvp<br>qvstptlvevsrnlgkvgskcckhpeakrmpcaedylsvvlnqlcvlhektpvsdrvtkccteslvnrrpcfsalevdetyvpkefqaetftfha<br>dictlsekerqikkqtalvelvkhkpkatkeqlkavmddfaafvekcckaddketcfaeegkklvaasqaalglaaalqvqlvesggglvqpgg<br>slrlscaasgftfsdyvinwvrqapgkglewvsgiswsgvnthyadsvkgrftisrdnskntlylqmnslraedtavyycarlgatannirykfm<br>dvwgqgtlvtvssggggsggggsggggsggggsdieltqppsvsvapgqtariscsgdslrnkvywyqqkpgqapvlviyknnrpsgiperfs<br>gsnsgntatltisgtqaedeadyycqsydgqkslvfgggtkltvlaaaenlyfqgshhhhhh |

TABLE 2-continued

Examples of LRP6 constructs

| SEQ ID NUMBER | Construct | Sequence |
|---|---|---|
| SEQ ID NO: 270 | 802 DNA | gatatcgtgctgacacagagccctgccaccctgtctctgagccctggcgagagagccaccctgagctgccgggccagccagttcatcggctccc gctacctggcctggtatcagcagaagcccggacaggctcccagactgctgatctacggcgccagcaacagagctaccggcgtgcccgccagatt ttctggcagcggcagcggcaccgacttcaccctgaccatcagcagcctggaacccgaggacttcgccacctactactgccagcagtactacgac taccccccagaccttcggccagggcaccaaggtggagatcaagggcggaggcggaagcgggggtggcggaagtggaggcggaggaagcgga gggggcggaagccaggtgcaattgaaagagtccggccctgccctggtgaagcctacccagaccctgaccctgacatgcaccttcagcggcttca gcctgagcaacagaggcggcggagtgggctggatcagacagcctcccggcaaggccctggaatggctggcctggatcgactgggacgacgac aagagctacagcaccagcctgaaaacccggctgaccatctccaaggacaccagcaagaaccaggtggtgctcaccatgaccaacatggaccc cgtggacaccgccacctattattgcgcccggatgcatctgcccctggtgttcgatagctggggccagggaaccctggtgacagtgtccagcgcgg cgagcgacgctcacaagagcgaagtggcacataggttcaaagatctgggcgaagagaactttaaggccctcgtcctgatcgctttcgcacagta cctccagcagtctccctttgaagatcacgtgaaactggtcaatgaggtgaccgaatttgccaagacatgcgtggctgatgagagtgcagaaaac tgtgacaaatcactgcatactctctttggagataagctgtgcaccgtcgccacactcagagagacttatggggaaatggctgactgttgcgcaaa acaggagcctgaacggaatgagtgtttcctccagcacaaggatgacaacccaaatctgccccgcctcgtgcgacctgaggtcgatgtgatgtgc accgcctttcatgacaacgaagagacattcctgaagaaatacctgtatgaaattgctcgtaggcacccatacttttatgcccccgagctcctgttc tttgcaaagagatacaaagctgccttcactgaatgttgccaggcagctgataaggccgcatgtctcctgcctaaactggacgagctccgggatga aggtaaggcttccagcgccaaacagcgcctgaagtgcgcttctctccagaagtttggcgagcgagcattcaaagcctgggctgtggcccgtctc agtcagaggtttccaaaggcagaatttgctgaggtctcaaaactggtgaccgacctcacaaaggtccatactgagtgttgccacggagatctgct ggaatgtgccgacgatagagcagacctcgctaaatatatctgcgagaatcaggattccattagctctaagctgaaagaatgttgcgagaagccc ctcctggaaaagagtcattgtatcgccgaggtggaaaacgacgagatgccagcagatctgccatcactcgctgccgactttgtggaatccaaag atgtctgcaagaattacgcagaggctaaagacgtgttcctggggatgtttctgtatgagtacgcccggcgtcaccccgattatagcgtcgtgctcc tgctccgactggcaaagacctacgaaacaactctggagaaatgttgcgctgccgcagaccctcatgaatgttatgctaaggtgttcgatgagttt aagccactcgtcgaagagccccagaacctgattaaacagaattgcgaactgttcgagcagctcggtgaatacaagtttcagaacgccctgctcg tgcgttataccaaaaaggtccctcaggtgtctacaccaactctggtggaggtcagtaggaatctgggcaaagtgggatcaaagtgttgcaaaca ccccgaggcaaagagaatgccttgtgctgaagattacctctccgtcgtgctgaaccagctctgcgtgctgcatgaaaagaccccagtcagcgat cgggtgacaaaatgttgcaccgaatctctggtcaatcgccgaccctgtttcagtgccctcgaagtggacgaaacttatgtgcctaaggagtttca ggctgaaacattcacctttcacgccgatatctgcactctgtccgagaaagaaaggcagattaagaaacagacagcactggtcgagctcgtgaa gcataaaccaaaggctaccaaggagcagctgaaagccgtcatggacgatttcgcagcttttgtggaaaagtgttgcaaagccgacgataagga gacttgtttcgcagaagaggggaaaaagctcgtggctgccagccaggcagctctgggtctggcggcggcgctgcaggttcaattggttgaaagc ggtggtggtctggttcagcctggtggtagcctgcgtctgagctgtgcagcaagcggttttacctttagcgattatgtgattaattgggttcgtcagg caccgggtaaaggtctggaatgggttagcggtattagctggtcaggtgttaatacccattatgcagatagcgtgaaaggtcgttttaccattagcc gtgataatagcaaaaataccctgtatctgcagatgaatagcctgcgtgcagaagataccgcagtttattattgtgcacgtctgggtgcaaccgca aataatattcgctataaatttatggatgtgtggggtcagggtacactagttaccgttagcagtggtggtggcggcagcggcggtggcggttccgg cggtggtggcagcggtggtggtggtagcgatatcgaactgacccagcctccgagcgttagcgttgcaccgggtcagaccgcacgtattagctgt agcggtgatagtctgcgtaataaagtttattggtatcagcagaaaccgggtcaggctccggttctggttatttataaaaataatcgtccgagcggt attccggaacgttttagcggtagcaatagcggtaataccgcaaccctgaccattagcggcacccaggcagaagatgaagccgattattattgtc agagctatgatggtcagaaaagcctggtttttggtggtggcaccaagcttaccgttctggcggccgcagagaacctgtattttcagggtagccac catcatcaccatcac |
| 802T | | |
| SEQ ID NO: 271 | 802T | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKGGGGSGGGGSGGGGSGGGGSQVQLKESGPALVKPTQTLTLTCTFS GFSLSNRGGGVGWIRQPPGKALEWLAWIDWDDDKSYSTSLKTRLTISKDTSKNQVVLTMTNMDPVDTATYYCAR FHLPLVFDSWGQGTLVTVSSAASDAHKSEVAHRFKDLGEENFKALVLIAFAQYLQQSPFEDHVKLVNEVTEFAKTC VADESAENCDKSLHTLFGDKLCTVATLRETYGEMADCCAKQEPERNECFLQHKDDNPNLPRLVRPEVDVMCTAF HDNEETFLKKYLYEIARRHPYFYAPELLFFAKRYKAAFTECCQAADKAACLLPKLDELRDEGKASSAKQRLKCASLQK FGERAFKAWAVARLSQRFPKAEFAEVSKLVTDLTKVHTECCHGDLLECADDRADLAKYICENQDSISSKLKECCEKP LLEKSHCIAEVENDEMPADLPSLAADFVESKDVCKNYAEAKDVFLGMFLYEYARRHPDYSVVLLLRLAKTYETTLEKC |

TABLE 2-continued

Examples of LRP6 constructs

| SEQ ID NUMBER | Construct | Sequence |
|---|---|---|
| | | CAAADPHECYAKVFDEFKPLVEEPQNLIKQNCELFEQLGEYKFQNALLVRYTKKVPQVSTPTLVEVSRNLGKVGSKC<br>CKHPEAKRMPCAEDYLSVVLNQLCVLHEKTPVSDRVTKCCTESLVNRRPCFSALEVDETYVPKEFQAETFTFHADIC<br>TLSEKERQIKKQTALVELVKHKPKATKEQLKAVMDDFAAFVEKCCKADDKETCFAEEGKKLVAASQAALGLAAALQ<br>VQLVESGGGLVQPGGSLRLSCAASGFTFSDYVMNWVRQAPGKGLEWVAGISWSGVNTHYADSVKGRFTISRDN<br>SKNTLYLQMNSLRAEDTAVYYCARLGATANNIRYKFMDVWGQGTLVTVSSGGGGSGGGGSGGGGSGGGGSDIE<br>LTQPPSVSVAPGQTARISCSGDSLRNKVYWYQQKPGQAPVLVIYKNNRPSGIPERFSGSNSGNTATLTISGTQAED<br>EADYYCQSYDGQKSLVFGGGTKLTVLAAAENLYFQGSHHHHHH |
| SEQ ID NO: 272 | 802T DNA | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>taccccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc<br>cgtggacaccgccacctattattgcgcccggtttcatctgccccctggtgttcgatagctggggccagggaaccctggtgacagtgtccagcgcgg<br>cgagcgacgctcacaagagcgaagtggcacataggttcaaagatctgggcgaagagaactttaaggccctcgtcctgatcgctttcgcacagta<br>cctccagcagtctccctttgaagatcacgtgaaactggtcaatgaggtgaccgaatttgccaagacatgcgtggctgatgagagtgcagaaaac<br>tgtgacaaatcactgcatactctctttggagataagctgtgcaccgtcgccacactcagagagacttatggggaaatggctgactgttgcgcaaa<br>acaggagcctgaacggaatgagtgtttcctccagcacaaggatgacaacccaaatctgccccgcctcgtgcgacctgaggtcgatgtgatgtgc<br>accgcctttcatgacaacgaagagacattcctgaagaaatacctgtatgaaattgctcgtaggcacccatacttttatgcccccgagctcctgttc<br>tttgcaaagagatacaaagctgccttcactgaatgttgccaggcagctgataaggccgcatgtctcctgcctaaactggacgagctccgggatga<br>aggtaaggcttccagcgccaaacagcgcctgaagtgcgcttctctccagaagtttggcgagcgagcattcaaagcctgggctgtggcccgtctc<br>agtcagaggtttccaaaggcagaatttgctgaggtctcaaaactggtgaccgacctcacaaaggtccatactgagtgttgccacggagatctgct<br>ggaatgtgccgacgatagagcagacctcgctaaatatatctgcgagaatcaggattccattagctctaagctgaaagaatgttgcgagaagccc<br>ctcctggaaaagagtcattgtatcgccgaggtggaaaacgacgagatgccagcagatctgccatcactcgctgccgactttgtggaatccaaag<br>atgtctgcaagaattacgcagaggctaaagacgtgttcctggggatgtttctgtatgagtacgcccggcgtcaccccgattatagcgtcgtgctcc<br>tgctccgactggcaaagacctacgaaacaactctggagaaatgttgcgctgccgcagaccctcatgaatgttatgctaaggtgttcgatgagttt<br>aagccactcgtcgaagagccccagaacctgattaaacagaattgcgaactgttcgagcagctcggtgaatacaagtttcagaacgccctgctcg<br>tgcgttataccaaaaaggtccctcaggtgtctacaccaactctggtggaggtcagtaggaatctgggcaaagtgggatcaaagtgttgcaaaca<br>ccccgaggcaaagagaatgccttgtgctgaagattacctctccgtcgtgctgaaccagctctgcgtgctgcatgaaaagaccccagtcagcgat<br>cgggtgacaaaatgttgcaccgaatctctggtcaatcgccgaccctgtttcagtgccctcgaagtggacgaaacttatgtgcctaaggagtttca<br>ggctgaaacattcacctttcacgccgatatctgcactctgtccgagaaagaaaggcagattaagaaacagacagcactggtcgagctcgtgaa<br>gcataaaccaaaggctaccaaggagcagctgaaagccgtcatggacgatttcgcagcttttgtggaaaagtgttgcaaagccgacgataagga<br>gacttgtttcgcagaagagggggaaaaagctcgtggctgccagccaggcagctctgggtctggcggcggcgctgcaggttcaattggttgaaagc<br>ggtggtggtctggttcagcctggtggtagcctgcgtctgagctgtgcagcaagcggttttacctttagcgattatgtgatgaattgggttcgtcagg<br>caccgggtaaaggtctggaatgggttgccggtattagctggtcaggtgttaatacccattatgcagatagcgtgaaaggtcgttttaccattagcc<br>gtgataatagcaaaaataccctgtatctgcagatgaatagcctgcgtgcagaagataccgcagtttattattgtgcacgtctgggtgcaaccgca<br>aataatattcgctataaatttatggatgtgtggggtcagggtacactagttaccgttagcagtggtggtggcggcagcggcggtggcggttccgg<br>cggtggtggcagcggtggtggtggtagcgatatcgaactgacccagcctccgagcgttagcgttgcaccgggtcagaccgcacgtattagctgt<br>agcggtgatagtctgcgtaataaagtttattggtatcagcagaaaccgggtcaggctccggttctggttatttataaaaataatcgtccgagcggt<br>attccggaacgttttagcggtagcaatagcggtaataccgcaaccctgaccattagcggcacccaggcagaagatgaagccgattattattgtc |

TABLE 2-continued

Examples of LRP6 constructs

| SEQ ID NUMBER | Construct | Sequence |
|---|---|---|
| | | agagctatgatggtcagaaaagcctggtttttggtggtggcaccaagcttaccgttctggcggccgcagagaacctgtattttcagggtagccac catcatcaccatcac |
| 803T | | |
| SEQ ID NO: 273 | 803T | QVQLVESGGGLVQPGGSLRLSCAASGFTFSDYVMNWVRQAPGKGLEWVAGISWSGVNTHYADSVKGRFTISRD NSKNTLYLQMNSLRAEDTAVYYCARLGATANNIRYKFMDVWGQGTLVTVSSGGGGSGGGGSGGGGSGGGGSD IELTQPPSVSVAPGQTARISCSGDSLRNKVYWYQQKPGQAPVLVIYKNNRPSGIPERFSGSNSGNTATLTISGTQAE DEADYYCQSYDGQKSLVFGGGTKLTVLGGGGSGGDAHKSEVAHRFKDLGEENFKALVLIAFAQYLQQSPFEDHVK LVNEVTEFAKTCVADESAENCDKSLHTLFGDKLCTVATLRETYGEMADCCAKQEPERNECFLQHKDDNPNLPRLVR PEVDVMCTAFHDNEETFLKKYLYEIARRHPYFYAPELLFFAKRYKAAFTECCQAADKAACLLPKLDELRDEGKASSAK QRLKCASLQKFGERAFKAWAVARLSQRFPKAEFAEVSKLVTDLTKVHTECCHGDLLECADDRADLAKYICENQDSIS SKLKECCEKPLLEKSHCIAEVENDEMPADLPSLAADFVESKDVCKNYAEAKDVFLGMFLYEYARRHPDYSVVLLLRL AKTYETTLEKCCAAADPHECYAKVFDEFKPLVEEPQNLIKQNCELFEQLGEYKFQNALLVRYTKKVPQVSTPTLVEVS RNLGKVGSKCCKHPEAKRMPCAEDYLSVVLNQLCVLHEKTPVSDRVTKCCTESLVNRRPCFSALEVDETYVPKEFQ AETFTFHADICTLSEKERQIKKQTALVELVKHKPKATKEQLKAVMDDFAAFVEKCCKADDKETCFAEEGKKLVAASQ AALGLGGGGSGGGGSGGGGSDIVLTQSPATLSLSPGERATLSCRASQFIGSRYLAWYQQKPGQAPRLLIYGASNRA TGVPARFSGSGSGTDFTLTISSLEPEDFATYYCQQYYDYPQTFGQGTKVEIKGGGGSGGGGSGGGGSGGGGSQVQ LKESGPALVKPTQTLTLTCTFSGFSLSNRGGGVGWIRQPPGKALEWLAWIDWDDDKSYSTSLKTRLTISKDTSKNQ VVLTMTNMDPVDTATYYCARFHLPLVFDSWGQGTLVTVSSAAAENLYFQGSHHHHHH |
| SEQ ID NO: 274 | 803T DNA | caggttcaattggttgaaagcggtggtggtctggttcagcctggtggtagcctgcgtctgagctgtgcagcaagcggttttacctttagcgattatg tgatgaattgggttcgtcaggcaccgggtaaaggtctggaatgggttgccggtattagctggtcaggtgttaatacccattatgcagatagcgtg aaaggtcgttttaccattagccgtgataatagcaaaaataccctgtatctgcagatgaatagcctgcgtgcagaagataccgcagtttattattgt gcacgtctgggtgcaaccgcaaataatattcgctataaatttatggatgtgtggggtcagggtacactagttaccgttagcagtggtggtggcgg cagcggcggtggcggttccggcggtggtggcagcggtggtggtggtagcgatatcgaactgacccagcctccgagcgttagcgttgcaccgggt cagaccgcacgtattagctgtagcggtgatagtctgcgtaataaagtttattggtatcagcagaaaccgggtcaggctccggttctggttatttat aaaaataatcgtccgagcggtattccggaacgttttagcggtagcaatagcggtaataccgcaaccctgaccattagcggcacccaggcagaa gatgaagccgattattattgtcagagctatgatggtcagaaaagcctggtttttggtggtggcaccaagcttaccgttctgggggggtggcggaag tgggggtgacgctcacaagagcgaagtggcacataggttcaaagatctgggcgaagagaactttaaggccctcgtcctgatcgctttcgcacag tacctccagcagtctccctttgaagatcacgtgaaactggtcaatgaggtgaccgaatttgccaagacatgcgtggctgatgagagtgcagaaa actgtgacaaatcactgcatactctctttggagataagctgtgcaccgtcgccacactcagagagacttatggggaaatggctgactgttgcgca aaacaggagcctgaacggaatgagtgtttcctccagcacaaggatgacaacccaaatctgccccgcctcgtgcgacctgaggtcgatgtgatgt gcaccgcctttcatgacaacgaagagacattcctgaagaaatacctgtatgaaattgctcgtaggcacccatacttttatgcccccgagctcctgt tctttgcaaagagatacaaagctgccttcactgaatgttgccaggcagctgataaggccgcatgtctcctgcctaaactggacgagctccgggat gaaggtaaggcttccagcgccaaacagcgcctgaagtgcgcttctctccagaagtttggcgagcgagcattcaaagcctgggctgtggcccgtc tcagtcagaggtttccaaaggcagaatttgctgaggtctcaaaactggtgaccgacctcacaaaggtccatactgagtgttgccacggagatctg ctggaatgtgccgacgatagagcagacctcgctaaatatatctgcgagaatcaggattccattagctctaagctgaaagaatgttgcgagaagc ccctcctggaaaagagtcattgtatcgccgaggtggaaaacgacgagatgccagcagatctgccatcactcgctgccgactttgtggaatccaa agatgtctgcaagaattacgcagaggctaaagacgtgttcctggggatgtttctgtatgagtacgcccggcgtcaccccgattatagcgtcgtgct cctgctccgactggcaaagacctacgaaacaactctggagaaatgttgcgctgccgcagaccctcatgaatgttatgctaaggtgttcgatgagt ttaagccactcgtcgaagagccccagaacctgattaaacagaattgcgaactgttcgagcagctcggtgaatacaagtttcagaacgccctgct cgtgcgttataccaaaaaggtccctcaggtgtctacaccaactctggtggaggtcagtaggaatctgggcaaagtgggatcaaagtgttgcaaa caccccgaggcaaagagaatgccttgtgctgaagattacctctccgtcgtgctgaaccagctctgcgtgctgcatgaaaagaccccagtcagcg atcgggtgacaaaatgttgcaccgaatctctggtcaatcgccgaccctgtttcagtgccctcgaagtggacgaaacttatgtgcctaaggagtttc aggctgaaacattcacctttcacgccgatatctgcactctgtccgagaaagaaaggcagattaagaaacagacagcactggtcgagctcgtga agcataaaccaaaggctaccaaggagcagctgaaagccgtcatggacgatttcgcagcttttgtggaaaagtgttgcaaagccgacgataagg agacttgtttcgcagaagaggggaaaaagctcgtggctgccagccaggcagctctgggtctgggggggtggcggaagtgggggtggcggaagt |

TABLE 2-continued

Examples of LRP6 constructs

| SEQ ID NUMBER | Construct | Sequence |
|---|---|---|
| | | gggggtggcggaagtgatatcgtgctgacacagagccctgccaccctgtctctgagccctggcgagagagccaccctgagctgccgggccagc<br>cagttcatcggctcccgctacctggcctggtatcagcagaagcccggacaggctcccagactgctgatctacggcgccagcaacagagctaccg<br>gcgtgcccgccagattttctggcagcggcagcggcaccgacttcaccctgaccatcagcagcctggaacccgaggacttcgccacctactactgc<br>cagcagtactacgactacccccagaccttcggccagggcaccaaggtggagatcaagggcggaggcggaagcgggggtggcggaagtggag<br>gcggaggaagcggagggggcggaagccaggtgcaattgaaagagtccggccctgccctggtgaagcctacccagaccctgaccctgacatgc<br>accttcagcggcttcagcctgagcaacagaggcggcggagtgggctggatcagacagcctcccggcaaggccctggaatggctggcctggatc<br>gactgggacgacgacaagagctacagcaccagcctgaaaacccggctgaccatctccaaggacaccagcaagaaccaggtggtgctcaccat<br>gaccaacatggaccccgtggacaccgccacctattattgcgcccggtttcatctgcccctggtgttcgatagctggggccagggaaccctggtga<br>cagtgtccagcgcggccgcagagaacctgtattttcagggtagccaccatcatcaccatcac |
| 804T | | |
| SEQ ID NO: 275 | 804T | DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKGGGGSGGGGSGGGGSGGGGSQVQLKESGPALVKPTQTLTLTCTFS<br>GFSLSNRGGGVGWIRQPPGKALEWLAWIDWDDDKSYSTSLKTRLTISKDTSKNQVVLTMTNMDPVDTATYYCAR<br>FHLPLVFDSWGQGTLVTVSSGGGGSGGDAHKSEVAHRFKDLGEENFKALVLIAFAQYLQQSPFEDHVKLVNEVTE<br>FAKTCVADESAENCDKSLHTLFGDKLCTVATLRETYGEMADCCAKQEPERNECFLQHKDDNPNLPRLVRPEVDVM<br>CTAFHDNEETFLKKYLYEIARRHPYFYAPELLFFAKRYKAAFTECCQAADKAACLLPKLDELRDEGKASSAKQRLKCA<br>SLQKFGERAFKAWAVARLSQRFPKAEFAEVSKLVTDLTKVHTECCHGDLLECADDRADLAKYICENQDSISSKLKEC<br>CEKPLLEKSHCIAEVENDEMPADLPSLAADFVESKDVCKNYAEAKDVFLGMFLYEYARRHPDYSVVLLLRLAKTYET<br>TLEKCCAAADPHECYAKVFDEFKPLVEEPQNLIKQNCELFEQLGEYKFQNALLVRYTKKVPQVSTPTLVEVSRNLGK<br>VGSKCCKHPEAKRMPCAEDYLSVVLNQLCVLHEKTPVSDRVTKCCTESLVNRRPCFSALEVDETYVPKEFQAETFTF<br>HADICTLSEKERQIKKQTALVELVKHKPKATKEQLKAVMDDFAAFVEKCCKADDKETCFAEEGKKLVAASQAALGL<br>GGGGSGGGGSGGGGSQVQLVESGGGLVQPGGSLRLSCAASGFTFSDYVMNWVRQAPGKGLEWVAGISWSGV<br>NTHYADSVKGRFTISRDNSKNTLYLQMNSLRAEDTAVYYCARLGATANNIRYKFMDVWGQGTLVTVSSGGGGSG<br>GGGSGGGGSGGGGSDIELTQPPSVSVAPGQTARISCSGDSLRNKVYWYQQKPGQAPVLVIYKNNRPSGIPERFSG<br>SNSGNTATLTISGTQAEDEADYYCQSYDGQKSLVFGGGTKLTVLAAAENLYFQGSHHHHHH |
| SEQ ID NO: 276 | 804T DNA | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>tacccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc<br>cgtggacaccgccacctattattgcgcccggtttcatctgcccctggtgttcgatagctggggccagggaaccctggtgacagtgtccagcgggg<br>gtggcggaagtggggtgacgctcacaagagcgaagtggcacataggttcaaagatctgggcgaagagaactttaaggccctcgtcctgatcg<br>ctttcgcacagtacctccagcagtctccctttgaagatcacgtgaaactggtcaatgaggtgaccgaatttgccaagacatgcgtggctgatgag<br>agtgcagaaaactgtgacaaatcactgcatactctctttggagataagctgtgcaccgtcgccacactcagagagacttatggggaaatggctg<br>actgttgcgcaaaacaggagcctgaacggaatgagtgtttcctccagcacaaggatgacaacccaaatctgccccgcctcgtgcgacctgaggt<br>cgatgtgatgtgcaccgcctttcatgacaacgaagagacattcctgaagaaatacctgtatgaaattgctcgtaggcacccatacttttatgcccc<br>cgagctcctgttctttgcaaagagatacaaagctgccttcactgaatgttgccaggcagctgataaggccgcatgtctcctgcctaaactggacg<br>agctccgggatgaaggtaaggcttccagcgccaaacagcgcctgaagtgcgcttctctccagaagtttggcgagcgagcattcaaagcctgggc<br>tgtggcccgtctcagtcagaggtttccaaaggcagaatttgctgaggtctcaaaactggtgaccgacctcacaaaggtccatactgagtgttgcc<br>acggagatctgctggaatgtgccgacgatagagcagacctcgctaaatatatctgcgagaatcaggattccattagctctaagctgaaagaatg<br>ttgcgagaagcccctcctggaaaagagtcattgtatcgccgaggtggaaaacgacgagatgccagcagatctgccatcactcgctgccgacttt<br>gtggaatccaaagatgtctgcaagaattacgcagaggctaaagacgtgttcctggggatgtttctgtatgagtacgcccggcgtcaccccgatta<br>tagcgtcgtgctcctgctccgactggcaaagacctacgaaacaactctggagaaatgttgcgctgccgcagaccctcatgaatgttatgctaagg |

TABLE 2-continued

Examples of LRP6 constructs

| SEQ ID NUMBER | Construct | Sequence |
|---|---|---|
| | | tgttcgatgagtttaagccactcgtcgaagagccccagaacctgattaaacagaattgcgaactgttcgagcagctcggtgaatacaagtttcag aacgccctgctcgtgcgttataccaaaaaggtccctcaggtgtctacaccaactctggtggaggtcagtaggaatctgggcaaagtgggatcaa agtgttgcaaacaccccgaggcaaagagaatgccttgtgctgaagattacctctccgtcgtgctgaaccagctctgcgtgctgcatgaaaagac cccagtcagcgatcgggtgacaaaatgttgcaccgaatctctggtcaatcgccgaccctgtttcagtgccctcgaagtggacgaaacttatgtgc ctaaggagtttcaggctgaaacattcacctttcacgccgatatctgcactctgtccgagaaagaaaggcagattaagaaacagacagcactggt cgagctcgtgaagcataaaccaaaggctaccaaggagcagctgaaagccgtcatggacgatttcgcagcttttgtggaaaagtgttgcaaagc cgacgataaggagacttgtttcgcagaagaggggaaaaagctcgtggctgccagccaggcagctctgggtctgggggtggcggaagtgggg gtggcggaagtgggggtggcggaagtcaggttcaattggttgaaagcggtggtggtctggttcagcctggtggtagcctgcgtctgagctgtgca gcaagcggttttacctttagcgattatgtgatgaattgggttcgtcaggcaccgggtaaaggtctggaatgggttgccggtattagctggtcaggt gttaatacccattatgcagatagcgtgaaaggtcgttttaccattagccgtgataatagcaaaaataccctgtatctgcagatgaatagcctgcgt gcagaagataccgcagtttattattgtgcacgtctgggtgcaaccgcaaataatattcgctataaatttatggatgtgtggggtcagggtacacta gttaccgttagcagtggtggtggcggcagcggcggtggcggttccggcggtggtggcagcggtggtggtggtagcgatatcgaactgacccagc ctccgagcgttagcgttgcaccgggtcagaccgcacgtattagctgtagcggtgatagtctgcgtaataaagtttattggtatcagcagaaaccg ggtcaggctccggttctggttatttataaaaataatcgtccgagcggtattccggaacgttttagcggtagcaatagcggtaataccgcaaccctg accattagcggcacccaggcagaagatgaagccgattattattgtcagagctatgatggtcagaaaagcctggtttttggtggtggcaccaagct taccgttctggcggccgcagagaacctgtattttcagggtagccaccatcatcaccatcac |
| 801T NT | | |
| SEQ ID NO: 277 | 801T NT | QVQLVESGGGLVQPGGSLRLSCAASGFTFSDYVMNWVRQAPGKGLEWVAGISWSGVNTHYADSVKGRFTISRD NSKNTLYLQMNSLRAEDTAVYYCARLGATANNIRYKFMDVWGQGTLVTVSSGGGGSGGGGSGGGGSGGGGSD IELTQPPSVSVAPGQTARISCSGDSLRNKVYWYQQKPGQAPVLVIYKNNRPSGIPERFSGSNSGNTATLTISGTQAE DEADYYCQSYDGQKSLVFGGGTKLTVLAASDAHKSEVAHRFKDLGEENFKALVLIAFAQYLQQSPFEDHVKLVNEV TEFAKTCVADESAENCDKSLHTLFGDKLCTVATLRETYGEMADCCAKQEPERNECFLQHKDDNPNLPRLVRPEVD VMCTAFHDNEETFLKKYLYEIARRHPYFYAPELLFFAKRYKAAFTECCQAADKAACLLPKLDELRDEGKASSAKQRLK CASLQKFGERAFKAWAVARLSQRFPKAEFAEVSKLVTDLTKVHTECCHGDLLECADDRADLAKYICENQDSISSKLK ECCEKPLLEKSHCIAEVENDEMPADLPSLAADFVESKDVCKNYAEAKDVFLGMFLYEYARRHPDYSVVLLLRLAKTY ETTLEKCCAAADPHECYAKVFDEFKPLVEEPQNLIKQNCELFEQLGEYKFQNALLVRYTKKVPQVSTPTLVEVSRNL GKVGSKCCKHPEAKRMPCAEDYLSVVLNQLCVLHEKTPVSDRVTKCCTESLVNRRPCFSALEVDETYVPKEFQAETF TFHADICTLSEKERQIKKQTALVELVKHKPKATKEQLKAVMDDFAAFVEKCCKADDKETCFAEEGKKLVAASQAAL GLAAALDIVLTQSPATLSLSPGERATLSCRASQFIGSRYLAWYQQKPGQAPRLLIYGASNRATGVPARFSGSGSGTD FTLTISSLEPEDFATYYCQQYYDYPQTFGQGTKVEIKGGGGSGGGGSGGGGSGGGGSQVQLKESGPALVKPTQTL TLTCTFSGFSLSNRGGGVGWIRQPPGKALEWLAWIDWDDDKSYSTSLKTRLTISKDTSKNQVVLTMTNMDPVDT ATYYCARFHLPLVFDSWGQGTLVTVSSAAA |
| SEQ ID NO: 278 | 801T NTDNA | caggttcaattggttgaaagcggtggtggtctggttcagcctggtggtagcctgcgtctgagctgtgcagcaagcggttttacctttagcgattatg tgatgaattgggttcgtcaggcaccgggtaaaggtctggaatgggttgccggtattagctggtcaggtgttaatacccattatgcagatagcgtg aaaggtcgttttaccattagccgtgataatagcaaaaataccctgtatctgcagatgaatagcctgcgtgcagaagataccgcagtttattattgt gcacgtctgggtgcaaccgcaaataatattcgctataaatttatggatgtgtggggtcagggtacactagttaccgttagcagtggtggtggcgg cagcggcggtggcggttccggcggtggtggcagcggtggtggtggtagcgatatcgaactgacccagcctccgagcgttagcgttgcaccgggt cagaccgcacgtattagctgtagcggtgatagtctgcgtaataaagtttattggtatcagcagaaaccgggtcaggctccggttctggttatttat aaaaataatcgtccgagcggtattccggaacgttttagcggtagcaatagcggtaataccgcaaccctgaccattagcggcacccaggcagaa gatgaagccgattattattgtcagagctatgatggtcagaaaagcctggtttttggtggtggcaccaagcttaccgttctggcggcgagcgacgct cacaagagcgaagtggcacataggttcaaagatctgggcgaagagaactttaaggccctcgtcctgatcgctttcgcacagtacctccagcagt ctccctttgaagatcacgtgaaactggtcaatgaggtgaccgaatttgccaagacatgcgtggctgatgagagtgcagaaaactgtgacaaatc actgcatactctctttggagataagctgtgcaccgtcgccacactcagagagacttatggggaaatggctgactgttgcgcaaaacaggagcct gaacggaatgagtgtttcctccagcacaaggatgacaacccaaatctgccccgcctcgtgcgacctgaggtcgatgtgatgtgcaccgcctttca tgacaacgaagagacattcctgaagaaatacctgtatgaaattgctcgtaggcacccatacttttatgcccccgagctcctgttctttgcaaagag |

TABLE 2-continued

| Examples of LRP6 constructs | | |
|---|---|---|
| SEQ ID NUMBER | Construct | Sequence |
| | | atacaaagctgccttcactgaatgttgccaggcagctgataaggccgcatgtctcctgcctaaactggacgagctccgggatgaaggtaaggctt<br>ccagcgccaaacagcgcctgaagtgcgcttctctccagaagtttggcgagcgagcattcaaagcctgggctgtggcccgtctcagtcagaggttt<br>ccaaaggcagaatttgctgaggtctcaaaactggtgaccgacctcacaaaggtccatactgagtgttgccacggagatctgctggaatgtgccg<br>acgatagagcagacctcgctaaatatatctgcgagaatcaggattccattagctctaagctgaaagaatgttgcgagaagcccctcctggaaaa<br>gagtcattgtatcgccgaggtggaaaacgacgagatgccagcagatctgccatcactcgctgccgactttgtggaatccaaagatgtctgcaag<br>aattacgcagaggctaaagacgtgttcctggggatgtttctgtatgagtacgcccggcgtcaccccgattatagcgtcgtgctcctgctccgactg<br>gcaaagacctacgaaacaactctggagaaatgttgcgctgccgcagaccctcatgaatgttatgctaaggtgttcgatgagtttaagccactcgt<br>cgaagagccccagaacctgattaaacagaattgcgaactgttcgagcagctcggtgaatacaagtttcagaacgccctgctcgtgcgttatacc<br>aaaaaggtccctcaggtgtctacaccaactctggtggaggtcagtaggaatctgggcaaagtgggatcaaagtgttgcaaacaccccgaggca<br>aagagaatgccttgtgctgaagattacctctccgtcgtgctgaaccagctctgcgtgctgcatgaaaagaccccagtcagcgatcgggtgacaa<br>aatgttgcaccgaatctctggtcaatcgccgaccctgtttcagtgccctcgaagtggacgaaacttatgtgcctaaggagtttcaggctgaaacat<br>tcacctttcacgccgatatctgcactctgtccgagaaagaaaggcagattaagaaacagacagcactggtcgagctcgtgaagcataaaccaa<br>aggctaccaaggagcagctgaaagccgtcatggacgatttcgcagcttttgtggaaaagtgttgcaaagccgacgataaggagacttgtttcgc<br>agaagaggggaaaaagctcgtggctgccagccaggcagctctgggtctggcggcggcgctggatatcgtgctgacacagagccctgccaccct<br>gtctctgagccctggcgagagagccaccctgagctgccgggccagccagttcatcggctcccgctacctggcctggtatcagcagaagcccgga<br>caggctcccagactgctgatctacggcgccagcaacagagctaccggcgtgcccgccagattttctggcagcggcagcggcaccgacttcaccc<br>tgaccatcagcagcctggaacccgaggacttcgccacctactactgccagcagtactacgactacccccagaccttcggccagggcaccaaggt<br>ggagatcaagggcggaggcggaagcgggggtggcggaagtggaggcggaggaagcggagggggcggaagccaggtgcaattgaaagagt<br>ccggccctgccctggtgaagcctacccagaccctgaccctgacatgcaccttcagcggcttcagcctgagcaacagaggcggcggagtgggctg<br>gatcagacagcctcccggcaaggccctggaatggctggcctggatcgactgggacgacgacaagagctacagcaccagcctgaaaacccggc<br>tgaccatctccaaggacaccagcaagaaccaggtggtgctcaccatgaccaacatggaccccgtggacaccgccacctattattgcgcccggtt<br>tcatctgccccctggtgttcgatagctggggccagggaaccctggtgacagtgtccagcgcggccgca |
| 802T NT | | |
| SEQ ID NO: 279 | 802T NT | DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKGGGGSGGGGSGGGGSGGGGSQVQLKESGPALVKPTQTLTLTCTFS<br>GFSLSNRGGGVGWIRQPPGKALEWLAWIDWDDDKSYSTSLKTRLTISKDTSKNQVVLTMTNMDPVDTATYYCAR<br>FHLPLVFDSWGQGTLVTVSSAASDAHKSEVAHRFKDLGEENFKALVLIAFAQYLQQSPFEDHVKLVNEVTEFAKTC<br>VADESAENCDKSLHTLFGDKLCTVATLRETYGEMADCCAKQEPERNECFLQHKDDNPNLPRLVRPEVDVMCTAF<br>HDNEETFLKKYLYEIARRHPYFYAPELLFFAKRYKAAFTECCQAADKAACLLPKLDELRDEGKASSAKQRLKCASLQK<br>FGERAFKAWAVARLSQRFPKAEFAEVSKLVTDLTKVHTECCHGDLLECADDRADLAKYICENQDSISSKLKECCEKP<br>LLEKSHCIAEVENDEMPADLPSLAADFVESKDVCKNYAEAKDVFLGMFLYEYARRHPDYSVVLLLRLAKTYETTLEKC<br>CAAADPHECYAKVFDEFKPLVEEPQNLIKQNCELFEQLGEYKFQNALLVRYTKKVPQVSTPTLVEVSRNLGKVGSKC<br>CKHPEAKRMPCAEDYLSVVLNQLCVLHEKTPVSDRVTKCCTESLVNRRPCFSALEVDETYVPKEFQAETFTFHADIC<br>TLSEKERQIKKQTALVELVKHKPKATKEQLKAVMDDFAAFVEKCCKADDKETCFAEEGKKLVAASQAALGLAAALQ<br>VQLVESGGGLVQPGGSLRLSCAASGFTFSDYVMNWVRQAPGKGLEWVAGISWSGVNTHYADSVKGRFTISRDN<br>SKNTLYLQMNSLRAEDTAVYYCARLGATANNIRYKFMDVWGQGTLVTVSSGGGGSGGGGSGGGGSGGGGSDIE<br>LTQPPSVSVAPGQTARISCSGDSLRNKVYWYQQKPGQAPVLVIYKNNRPSGIPERFSGSNSGNTATLTISGTQAED<br>EADYYCQSYDGQKSLVFGGGTKLTVLAAA |
| SEQ ID NO: 280 | 802T NT | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>tacccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc |

TABLE 2-continued

Examples of LRP6 constructs

| SEQ ID NUMBER | Construct | Sequence |
| --- | --- | --- |
| | | cgtggacaccgccacctattattgcgcccggtttcatctgcccctggtgttcgatagctggggccagggaaccctggtgacagtgtccagcgcgg<br>cgagcgacgctcacaagagcgaagtggcacataggttcaaagatctgggcgaagagaactttaaggccctcgtcctgatcgctttcgcacagta<br>cctccagcagtctccctttgaagatcacgtgaaactggtcaatgaggtgaccgaatttgccaagacatgcgtggctgatgagagtgcagaaaac<br>tgtgacaaatcactgcatactctctttggagataagctgtgcaccgtcgccacactcagagagacttatggggaaatggctgactgttgcgcaaa<br>acaggagcctgaacggaatgagtgtttcctccagcacaaggatgacaacccaaatctgccccgcctcgtgcgacctgaggtcgatgtgatgtgc<br>accgcctttcatgacaacgaagagacattcctgaagaaatacctgtatgaaattgctcgtaggcacccatacttttatgcccccgagctcctgttc<br>tttgcaaagagatacaaagctgccttcactgaatgttgccaggcagctgataaggccgcatgtctcctgcctaaactggacgagctccgggatga<br>aggtaaggcttccagcgccaaacagcgcctgaagtgcgcttctctccagaagtttggcgagcgagcattcaaagcctgggctgtggcccgtctc<br>agtcagaggtttccaaaggcagaatttgctgaggtctcaaaactggtgaccgacctcacaaaggtccatactgagtgttgccacggagatctgct<br>ggaatgtgccgacgatagagcagacctcgctaaatatatctgcgagaatcaggattccattagctctaagctgaaagaatgttgcgagaagccc<br>ctcctggaaaagagtcattgtatcgccgaggtggaaaacgacgagatgccagcagatctgccatcactcgctgccgactttgtggaatccaaag<br>atgtctgcaagaattacgcagaggctaaagacgtgttcctggggatgtttctgtatgagtacgcccggcgtcaccccgattatagcgtcgtgctcc<br>tgctccgactggcaaagacctacgaaacaactctggagaaatgttgcgctgccgcagaccctcatgaatgttatgctaaggtgttcgatgagttt<br>aagccactcgtcgaagagccccagaacctgattaaacagaattgcgaactgttcgagcagctcggtgaatacaagtttcagaacgccctgctcg<br>tgcgttataccaaaaaggtccctcaggtgtctacaccaactctggtggaggtcagtaggaatctgggcaaagtgggatcaaagtgttgcaaaca<br>ccccgaggcaaagagaatgccttgtgctgaagattacctctccgtcgtgctgaaccagctctgcgtgctgcatgaaaagaccccagtcagcgat<br>cgggtgacaaaatgttgcaccgaatctctggtcaatcgccgaccctgtttcagtgccctcgaagtggacgaaacttatgtgcctaaggagtttca<br>ggctgaaacattcacctttcacgccgatatctgcactctgtccgagaaagaaaggcagattaagaaacagacagcactggtcgagctcgtgaa<br>gcataaaccaaaggctaccaaggagcagctgaaagccgtcatggacgatttcgcagcttttgtggaaaagtgttgcaaagccgacgataagga<br>gacttgtttcgcagaagaggggaaaaagctcgtggctgccagccaggcagctctgggtctggcggcggcgctgcaggttcaattggttgaaagc<br>ggtggtggtctggttcagcctggtggtagcctgcgtctgagctgtgcagcaagcggttttacctttagcgattatgtgatgaattgggttcgtcagg<br>caccgggtaaaggtctggaatgggttgccggtattagctggtcaggtgttaatacccattatgcagatagcgtgaaaggtcgttttaccattagcc<br>gtgataatagcaaaaataccctgtatctgcagatgaatagcctgcgtgcagaagataccgcagtttattattgtgcacgtctgggtgcaaccgca<br>aataatattcgctataaatttatggatgtgtggggtcagggtacactagttaccgttagcagtggtggtggcggcagcggcggtggcggttccgg<br>cggtggtggcagcggtggtggtggtagcgatatcgaactgacccagcctccgagcgttagcgttgcaccgggtcagaccgcacgtattagctgt<br>agcggtgatagtctgcgtaataaagtttattggtatcagcagaaaccgggtcaggctccggttctggttatttataaaaataatcgtccgagcggt<br>attccggaacgttttagcggtagcaatagcggtaataccgcaaccctgaccattagcggcacccaggcagaagatgaagccgattattattgtc<br>agagctatgatggtcagaaaagcctggtttttggtggtggcaccaagcttaccgttctggcggccgca |
| 802T NL | | |
| SEQ ID NO: 281 | 802T NL | DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKGGGGSGGGGSGGGGSGGGGSQVQLKESGPALVKPTQTLTLTCTFS<br>GFSLSNRGGGVGWIRQPPGKALEWLAWIDWDDDKSYSTSLKTRLTISKDTSKNQVVLTMTNMDPVDTATYYCAR<br>FHLPLVFDSWGQGTLVTVSSDAHKSEVAHRFKDLGEENFKALVLIAFAQYLQQSPFEDHVKLVNEVTEFAKTCVAD<br>ESAENCDKSLHTLFGDKLCTVATLRETYGEMADCCAKQEPERNECFLQHKDDNPNLPRLVRPEVDVMCTAFHDN<br>EETFLKKYLYEIARRHPYFYAPELLFFAKRYKAAFTECCQAADKAACLLPKLDELRDEGKASSAKQRLKCASLQKFGER<br>AFKAWAVARLSQRFPKAEFAEVSKLVTDLTKVHTECCHGDLLECADDRADLAKYICENQDSISSKLKECCEKPLLEKS<br>HCIAEVENDEMPADLPSLAADFVESKDVCKNYAEAKDVFLGMFLYEYARRHPDYSVVLLLRLAKTYETTLEKCCAAA<br>DPHECYAKVFDEFKPLVEEPQNLIKQNCELFEQLGEYKFQNALLVRYTKKVPQVSTPTLVEVSRNLGKVGSKCCKHP<br>EAKRMPCAEDYLSVVLNQLCVLHEKTPVSDRVTKCCTESLVNRRPCFSALEVDETYVPKEFQAETFTFHADICTLSEK<br>ERQIKKQTALVELVKHKPKATKEQLKAVMDDFAAFVEKCCKADDKETCFAEEGKKLVAASQAALGLQVQLVESGG<br>GLVQPGGSLRLSCAASGFTFSDYVMNWVRQAPGKGLEWVAGISWSGVNTHYADSVKGRFTISRDNSKNTLYLQ<br>MNSLRAEDTAVYYCARLGATANNIRYKFMDVWGQGTLVTVSSGGGGSGGGGSGGGGSGGGGSDIELTQPPSVS<br>VAPGQTARISCSGDSLRNKVYWYQQKPGQAPVLVIYKNNRPSGIPERFSGSNSGNTATLTISGTQAEDEADYYCQS<br>YDGQKSLVFGGGTKLTVLAAAENLYFQGSHHHHHH |

TABLE 2-continued

Examples of LRP6 constructs

| SEQ ID NUMBER | Construct | Sequence |
|---|---|---|
| SEQ ID NO: 282 | 802T NL DNA | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>taccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc<br>cgtggacaccgccacctattattgcgcccggtttcatctgcccctggtgttcgatagctggggccagggaaccctggtgacagtgtccagcgacg<br>ctcacaagagcgaagtggcacataggttcaaagatctgggcgaagagaactttaaggccctcgtcctgatcgctttcgcacagtacctccagca<br>gtctccctttgaagatcacgtgaaactggtcaatgaggtgaccgaatttgccaagacatgcgtggctgatgagagtgcagaaaactgtgacaaa<br>tcactgcatactctctttggagataagctgtgcaccgtcgccacactcagagagacttatggggaaatggctgactgttgcgcaaaacaggagcc<br>tgaacggaatgagtgtttcctccagcacaaggatgacaacccaaatctgccccgcctcgtgcgacctgaggtcgatgtgatgtgcaccgcctttc<br>atgacaacgaagagacattcctgaagaaatacctgtatgaaattgctcgtaggcacccatacttttatgcccccgagctcctgttctttgcaaaga<br>gatacaaagctgccttcactgaatgttgccaggcagctgataaggccgcatgtctcctgcctaaactggacgagctccgggatgaaggtaaggc<br>ttccagcgccaaacagcgcctgaagtgcgcttctctccagaagtttggcgagcgagcattcaaagcctgggctgtggcccgtctcagtcagaggt<br>ttccaaaggcagaatttgctgaggtctcaaaactggtgaccgacctcacaaaggtccatactgagtgttgccacggagatctgctggaatgtgcc<br>gacgatagagcagacctcgctaaatatatctgcgagaatcaggattccattagctctaagctgaaagaatgttgcgagaagcccctcctggaaa<br>agagtcattgtatcgccgaggtggaaaacgacgagatgccagcagatctgccatcactcgctgccgactttgtggaatccaaagatgtctgcaa<br>gaattacgcagaggctaaagacgtgttcctggggatgtttctgtatgagtacgcccggcgtcaccccgattatagcgtcgtgctcctgctccgact<br>ggcaaagacctacgaaacaactctggagaaatgttgcgctgccgcagaccctcatgaatgttatgctaaggtgttcgatgagtttaagccactcg<br>tcgaagagccccagaacctgattaaacagaattgcgaactgttcgagcagctcggtgaatacaagtttcagaacgccctgctcgtgcgttatacc<br>aaaaaggtccctcaggtgtctacaccaactctggtggaggtcagtaggaatctgggcaaagtgggatcaaagtgttgcaaacaccccgaggca<br>aagagaatgccttgtgctgaagattacctctccgtcgtgctgaaccagctctgcgtgctgcatgaaaagaccccagtcagcgatcgggtgacaa<br>aatgttgcaccgaatctctggtcaatcgccgaccctgtttcagtgccctcgaagtggacgaaacttatgtgcctaaggagtttcaggctgaaacat<br>tcacctttcacgccgatatctgcactctgtccgagaaagaaaggcagattaagaaacagacagcactggtcgagctcgtgaagcataaaccaa<br>aggctaccaaggagcagctgaaagccgtcatggacgatttcgcagcttttgtggaaaagtgttgcaaagccgacgataaggagacttgtttcgc<br>agaagaggggaaaaagctcgtggctgccagccaggcagctctgggtctgcaggttcaattggttgaaagcggtggtggtctggttcagcctggt<br>ggtagcctgcgtctgagctgtgcagcaagcggttttacctttagcgattatgtgatgaattgggttcgtcaggcaccgggtaaaggtctggaatgg<br>gttgccggtattagctggtcaggtgttaatacccattatgcagatagcgtgaaaggtcgttttaccattagccgtgataatagcaaaaataccctg<br>tatctgcagatgaatagcctgcgtgcagaagataccgcagtttattattgtgcacgtctgggtgcaaccgcaaataatattcgctataaatttatg<br>gatgtgtggggtcagggtacactagttaccgttagcagtggtggtggcggcagcggcggtggcggttccggcggtggtggcagcggtggtggtg<br>gtagcgatatcgaactgacccagcctccgagcgttagcgttgcaccgggtcagaccgcacgtattagctgtagcggtgatagtctgcgtaataaa<br>gtttattggtatcagcagaaaccgggtcaggctccggttctggttatttataaaaataatcgtccgagcggtattccggaacgttttagcggtagc<br>aatagcggtaataccgcaaccctgaccattagcggcacccaggcagaagatgaagccgattattattgtcagagctatgatggtcagaaaagc<br>ctggtttttggtggtggcaccaagcttaccgttctggcggccgcagagaacctgtattttcagggtagccaccatcatcaccatcac |
| 808T | | |
| SEQ ID NO: 283 | 808T | DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKGGGGSGGGGSGGGGSGGGGSQVQLKESGPALVKPTQTLTLTCTFS<br>GFSLSNRGGGVGWIRQPPGKALEWLAWIDWDDDKSYSTSLKTRLTISKDTSKNQVVLTMTNMDPVDTATYYCAR<br>FHLPLVFDSWGQGTLVTVSSKTHTDAHKSEVAHRFKDLGEENFKALVLIAFAQYLQQSPFEDHVKLVNEVTEFAKT<br>CVADESAENCDKSLHTLFGDKLCTVATLRETYGEMADCCAKQEPERNECFLQHKDDNPNLPRLVRPEVDVMCTAF<br>HDNEETFLKKYLYEIARRHPYFYAPELLFFAKRYKAAFTECCQAADKAACLLPKLDELRDEGKASSAKQRLKCASLQK<br>FGERAFKAWAVARLSQRFPKAEFAEVSKLVTDLTKVHTECCHGDLLECADDRADLAKYICENQDSISSKLKECCEKP<br>LLEKSHCIAEVENDEMPADLPSLAADFVESKDVCKNYAEAKDVFLGMFLYEYARRHPDYSVVLLLRLAKTYETTLEKC<br>CAAADPHECYAKVFDEFKPLVEEPQNLIKQNCELFEQLGEYKFQNALLVRYTKKVPQVSTPTLVEVSRNLGKVGSKC |

TABLE 2-continued

Examples of LRP6 constructs

| SEQ ID NUMBER | Construct | Sequence |
|---|---|---|
| | | CKHPEAKRMPCAEDYLSVVLNQLCVLHEKTPVSDRVTKCCTESLVNRRPCFSALEVDETYVPKEFQAETFTFHADIC<br>TLSEKERQIKKQTALVELVKHKPKATKEQLKAVMDDFAAFVEKCCKADDKETCFAEEGKKLVAASQAALGLKTHTQ<br>VQLVESGGGLVQPGGSLRLSCAASGFTFSDYVMNWVRQAPGKGLEWVAGISWSGVNTHYADSVKGRFTISRDN<br>SKNTLYLQMNSLRAEDTAVYYCARLGATANNIRYKFMDVWGQGTLVTVSSGGGGSGGGGSGGGGSGGGGSDIE<br>LTQPPSVSVAPGQTARISCSGDSLRNKVYWYQQKPGQAPVLVIYKNNRPSGIPERFSGSNSGNTATLTISGTQAED<br>EADYYCQSYDGQKSLVFGGGTKLTVLAAAENLYFQGSHHHHHH |
| SEQ ID NO: 284 | 808T DNA | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>taccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc<br>cgtggacaccgccacctattattgcgcccggtttcatctgcccctggtgttcgatagctggggccagggaaccctggtgacagtgtccagcaaga<br>cccacaccgacgctcacaagagcgaagtggcacataggttcaaagatctgggcgaagagaactttaaggccctcgtcctgatcgctttcgcaca<br>gtacctccagcagtctccctttgaagatcacgtgaaactggtcaatgaggtgaccgaatttgccaagacatgcgtggctgatgagagtgcagaa<br>aactgtgacaaatcactgcatactctctttggagataagctgtgcaccgtcgccacactcagagagacttatggggaaatggctgactgttgcgc<br>aaaacaggagcctgaacggaatgagtgtttcctccagcacaaggatgacaacccaaatctgccccgcctcgtgcgacctgaggtcgatgtgatg<br>tgcaccgcctttcatgacaacgaagagacattcctgaagaaatacctgtatgaaattgctcgtaggcacccatacttttatgcccccgagctcctg<br>ttctttgcaaagagatacaaagctgccttcactgaatgttgccaggcagctgataaggccgcatgtctcctgcctaaactggacgagctccggga<br>tgaaggtaaggcttccagcgccaaacagcgcctgaagtgcgcttctctccagaagtttggcgagcgagcattcaaagcctgggctgtggcccgt<br>ctcagtcagaggtttccaaaggcagaatttgctgaggtctcaaaactggtgaccgacctcacaaaggtccatactgagtgttgccacggagatct<br>gctggaatgtgccgacgatagagcagacctcgctaaatatatctgcgagaatcaggattccattagctctaagctgaaagaatgttgcgagaag<br>cccctcctggaaaagagtcattgtatcgccgaggtggaaaacgacgagatgccagcagatctgccatcactcgctgccgactttgtggaatcca<br>aagatgtctgcaagaattacgcagaggctaaagacgtgttcctggggatgtttctgtatgagtacgcccggcgtcaccccgattatagcgtcgtg<br>ctcctgctccgactggcaaagacctacgaaacaactctggagaaatgttgcgctgccgcagaccctcatgaatgttatgctaaggtgttcgatga<br>gtttaagccactcgtcgaagagccccagaacctgattaaacagaattgcgaactgttcgagcagctcggtgaatacaagtttcagaacgccctg<br>ctcgtgcgttataccaaaaaggtccctcaggtgtctacaccaactctggtggaggtcagtaggaatctgggcaaagtgggatcaaagtgttgca<br>aacaccccgaggcaaagagaatgccttgtgctgaagattacctctccgtcgtgctgaaccagctctgcgtgctgcatgaaaagaccccagtcag<br>cgatcgggtgacaaaatgttgcaccgaatctctggtcaatcgccgaccctgtttcagtgccctcgaagtggacgaaacttatgtgcctaaggagt<br>ttcaggctgaaacattcacctttcacgccgatatctgcactctgtccgagaaagaaaggcagattaagaaacagacagcactggtcgagctcgt<br>gaagcataaaccaaaggctaccaaggagcagctgaaagccgtcatggacgatttcgcagcttttgtggaaaagtgttgcaaagccgacgataa<br>ggagacttgtttcgcagaagaggggaaaaagctcgtggctgccagccaggcagctctgggtctgaagacccacacccaggttcaattggttga<br>aagcggtggtggtctggttcagcctggtggtagcctgcgtctgagctgtgcagcaagcggttttacctttagcgattatgtgatgaattgggttcgt<br>caggcaccgggtaaaggtctggaatgggttgccggtattagctggtcaggtgttaatacccattatgcagatagcgtgaaaggtcgttttaccatt<br>agccgtgataatagcaaaaataccctgtatctgcagatgaatagcctgcgtgcagaagataccgcagtttattattgtgcacgtctgggtgcaac<br>cgcaaataatattcgctataaatttatggatgtgtggggtcagggtacactagttaccgttagcagtggtggtggcggcagcggcggtggcggtt<br>ccggcggtggtggcagcggtggtggtggtagcgatatcgaactgacccagcctccgagcgttagcgttgcaccgggtcagaccgcacgtattag<br>ctgtagcggtgatagtctgcgtaataaagtttattggtatcagcagaaaccgggtcaggctccggttctggttatttataaaaataatcgtccgag<br>cggtattccggaacgttttagcggtagcaatagcggtaataccgcaaccctgaccattagcggcacccaggcagaagatgaagccgattattat |

TABLE 2-continued

Examples of LRP6 constructs

| SEQ ID NUMBER | Construct | Sequence |
|---|---|---|
| | | tgtcagagctatgatggtcagaaaagcctggtttttggtggtggcaccaagcttaccgttctggcggccgcagagaacctgtattttcagggtagc caccatcatcaccatcac |
| 812T | | |
| SEQ ID NO: 285 | 812T | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKGGGGSGGGGSGGGGSGGGGSQVQLKESGPALVKPTQTLTLTCTFS GFSLSNRGGGVGWIRQPPGKALEWLAWIDWDDDKSYSTSLKTRLTISKDTSKNQVVLTMTNMDPVDTATYYCAR FHLPLVFDSWGQGTLVTVSSGGGGSGGGGSGGGGSQVQLVESGGGLVQPGGSLRLSCAASGFTFSDYVMNWV RQAPGKGLEWVAGISWSGVNTHYADSVKGRFTISRDNSKNTLYLQMNSLRAEDTAVYYCARLGATANNIRYKFM DVWGQGTLVTVSSGGGGSGGGGSGGGGSGGGGSDIELTQPPSVSVAPGQTARISCSGDSLRNKVYWYQQKPG QAPVLVIYKNNRPSGIPERFSGSNSGNTATLTISGTQAEDEADYYCQSYDGQKSLVFGGGTKLTVLAAAENLYFQGS HHHHHH |
| SEQ ID NO: 286 | 812T DNA | gatatcgtgctgacacagagccctgccaccctgtctctgagccctggcgagagagccaccctgagctgccgggccagccagttcatcggctccc gctacctggcctggtatcagcagaagcccggacaggctcccagactgctgatctacggcgccagcaacagagctaccggcgtgcccgccagatt ttctggcagcggcagcggcaccgacttcaccctgaccatcagcagcctggaacccgaggacttcgccacctactactgccagcagtactacgac taccccagaccttcggccagggcaccaaggtggagatcaagggcggaggcggaagcgggggtggcggaagtggaggcggaggaagcgga gggggcggaagccaggtgcaattgaaagagtccggccctgccctggtgaagcctacccagaccctgaccctgacatgcaccttcagcggcttca gcctgagcaacagaggcggcggagtgggctggatcagacagcctcccggcaaggccctggaatggctggcctggatcgactgggacgacgac aagagctacagcaccagcctgaaaacccggctgaccatctccaaggacaccagcaagaaccaggtggtgctcaccatgaccaacatggaccc cgtggacaccgccacctattattgcgcccggtttcatctgcccctggtgttcgatagctggggccagggaaccctggtgacagtgtccagcggag gtggcgggagtggtggagggggctcaggcgggggtggatctcaggttcaattggttgaaagcggtggtggtctggttcagcctggtggtagcct gcgtctgagctgtgcagcaagcggttttacctttagcgattatgtgatgaattgggttcgtcaggcaccgggtaaaggtctggaatgggttgccgg tattagctggtcaggtgttaatacccattatgcagatagcgtgaaaggtcgttttaccattagccgtgataatagcaaaaataccctgtatctgca gatgaatagcctgcgtgcagaagataccgcagtttattattgtgcacgtctgggtgcaaccgcaaataatattcgctataaatttatggatgtgtg gggtcagggtacactagttaccgttagcagtggtggtggcggcagcggcggtggcggttccggcggtggtggcagcggtggtggtggtagcgat atcgaactgacccagcctccgagcgttagcgttgcaccgggtcagaccgcacgtattagctgtagcggtgatagtctgcgtaataaagtttattg gtatcagcagaaaccgggtcaggctccggttctggttatttataaaaataatcgtccgagcggtattccggaacgttttagcggtagcaatagcg gtaataccgcaaccctgaccattagcggcacccaggcagaagatgaagccgattattattgtcagagctatgatggtcagaaaagcctggttttt ggtggtggcaccaagcttaccgttctggcggccgcagagaacctgtattttcagggtagccaccatcatcaccatcac |
| 812T-HSA | | |
| SEQ ID NO: 287 | 812T-HSA | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKGGGGSGGGGSGGGGSGGGGSQVQLKESGPALVKPTQTLTLTCTFS GFSLSNRGGGVGWIRQPPGKALEWLAWIDWDDDKSYSTSLKTRLTISKDTSKNQVVLTMTNMDPVDTATYYCAR FHLPLVFDSWGQGTLVTVSSGGGGSGGGGSGGGGSQVQLVESGGGLVQPGGSLRLSCAASGFTFSDYVMNWV RQAPGKGLEWVAGISWSGVNTHYADSVKGRFTISRDNSKNTLYLQMNSLRAEDTAVYYCARLGATANNIRYKFM DVWGQGTLVTVSSGGGGSGGGGSGGGGSGGGGSDIELTQPPSVSVAPGQTARISCSGDSLRNKVYWYQQKPG QAPVLVIYKNNRPSGIPERFSGSNSGNTATLTISGTQAEDEADYYCQSYDGQKSLVFGGGTKLTVLDKTHTDAHKSE VAHRFKDLGEENFKALVLIAFAQYLQQSPFEDHVKLVNEVTEFAKTCVADESAENCDKSLHTLFGDKLCTVATLRET YGEMADCCAKQEPERNECFLQHKDDNPNLPRLVRPEVDVMCTAFHDNEETFLKKYLYEIARRHPYFYAPELLFFAK RYKAAFTECCQAADKAACLLPKLDELRDEGKASSAKQRLKCASLQKFGERAFKAWAVARLSQRFPKAEFAEVSKLV TDLTKVHTECCHGDLLECADDRADLAKYICENQDSISSKLKECCEKPLLEKSHCIAEVENDEMPADLPSLAADFVESK DVCKNYAEAKDVFLGMFLYEYARRHPDYSVVLLLRLAKTYETTLEKCCAAADPHECYAKVFDEFKPLVEEPQNLIKQ |

TABLE 2-continued

| Examples of LRP6 constructs | | |
|---|---|---|
| SEQ ID NUMBER | Construct | Sequence |
| | | NCELFEQLGEYKFQNALLVRYTKKVPQVSTPTLVEVSRNLGKVGSKCCKHPEAKRMPCAEDYLSVVLNQLCVLHEK TPVSDRVTKCCTESLVNRRPCFSALEVDETYVPKEFQAETFTFHADICTLSEKERQIKKQTALVELVKHKPKATKEQLK AVMDDFAAFVEKCCKADDKETCFAEEGKKLVAASQAALGLAAAHHHHHH |
| SEQ ID NO: 288 | 812T-HSA DNA | gatatcgtgctgacacagagccctgccaccctgtctctgagccctggcgagagagccaccctgagctgccgggccagccagttcatcggctccc gctacctggcctggtatcagcagaagcccggacaggctcccagactgctgatctacggcgccagcaacagagctaccggcgtgcccgccagatt ttctggcagcggcagcggcaccgacttcaccctgaccatcagcagcctggaacccgaggacttcgccacctactactgccagcagtactacgac taccccccagaccttcggccagggcaccaaggtggagatcaagggcggaggcggaagcggggggtggcggaagtggaggcggaggaagcgga gggggcggaagccaggtgcaattgaaagagtccggccctgccctggtgaagcctacccagaccctgaccctgacatgcaccttcagcggcttca gcctgagcaacagaggcggcggagtgggctggatcagacagcctcccggcaaggccctggaatggctggcctggatcgactgggacgacgac aagagctacagcaccagcctgaaaacccggctgaccatctccaaggacaccagcaagaaccaggtggtgctcaccatgaccaacatggaccc cgtggacaccgccacctattattgcgcccggtttcatctgcccctggtgttcgatagctggggccagggaaccctggtgacagtgtccagcggag gtggcgggagtggtggagggggctcaggcgggggtggatctcaggttcaattggttgaaagcggtggtggtctggttcagcctggtggtagcct gcgtctgagctgtgcagcaagcggttttacctttagcgattatgtgatgaattgggttcgtcaggcaccgggtaaaggtctggaatgggttgccgg tattagctggtcaggtgttaatacccattatgcagatagcgtgaaaggtcgttttaccattagccgtgataatagcaaaaataccctgtatctgca gatgaatagcctgcgtgcagaagataccgcagtttattattgtgcacgtctgggtgcaaccgcaaataatattcgctataaatttatggatgtgtg gggtcagggtacactagttaccgttagcagtggtggtggcggcagcggcggtggcggttccggcggtggtggcagcggtggtggtggtagcgat atcgaactgacccagcctccgagcgttagcgttgcaccgggtcagaccgcacgtattagctgtagcggtgatagtctgcgtaataaagtttattg gtatcagcagaaaccgggtcaggctccggttctggttatttataaaaataatcgtccgagcggtattccggaacgttttagcggtagcaatagcg gtaataccgcaaccctgaccattagcggcacccaggcagaagatgaagccgattattattgtcagagctatgatggtcagaaaagcctggtttt ggtggtggcaccaagcttaccgttctggacaagacccacaccgacgctcacaagagcgaagtggcacataggttcaaagatctgggcgaaga gaactttaaggccctcgtcctgatcgctttcgcacagtacctccagcagtctccctttgaagatcacgtgaaactggtcaatgaggtgaccgaatt tgccaagacatgcgtggctgatgagagtgcagaaaactgtgacaaatcactgcatactctctttggagataagctgtgcaccgtcgccacactc agagagacttatggggaaatggctgactgttgcgcaaaacaggagcctgaacggaatgagtgtttcctccagcacaaggatgacaacccaaat ctgccccgcctcgtgcgacctgaggtcgatgtgatgtgcaccgcctttcatgacaacgaagagacattcctgaagaaatacctgtatgaaattgc tcgtaggcacccatacttttatgcccccgagctcctgttctttgcaaagagatacaaagctgccttcactgaatgttgccaggcagctgataaggc cgcatgtctcctgcctaaactggacgagctccgggatgaaggtaaggcttccagcgccaaacagcgcctgaagtgcgcttctctccagaagtttg gcgagcgagcattcaaagcctgggctgtggcccgtctcagtcagaggtttccaaaggcagaatttgctgaggtctcaaaactggtgaccgacct cacaaaggtccatactgagtgttgccacggagatctgctggaatgtgccgacgatagagcagacctcgctaaatatatctgcgagaatcaggat tccattagctctaagctgaaagaatgttgcgagaagcccctcctggaaaagagtcattgtatcgccgaggtggaaaacgacgagatgccagca gatctgccatcactcgctgccgactttgtggaatccaaagatgtctgcaagaattacgcagaggctaaagacgtgttcctggggatgtttctgtat gagtacgcccggcgtcaccccgattatagcgtcgtgctcctgctccgactggcaaagacctacgaaacaactctggagaaatgttgcgctgccg cagaccctcatgaatgttatgctaaggtgttcgatgagtttaagccactcgtcgaagagccccagaacctgattaaacagaattgcgaactgttc gagcagctcggtgaatacaagtttcagaacgccctgctcgtgcgttataccaaaaaggtccctcaggtgtctacaccaactctggtggaggtcag taggaatctgggcaaagtgggatcaaagtgttgcaaacaccccgaggcaaagagaatgccttgtgctgaagattacctctccgtcgtgctgaac cagctctgcgtgctgcatgaaaagaccccagtcagcgatcgggtgacaaaatgttgcaccgaatctctggtcaatcgccgaccctgtttcagtgc cctcgaagtggacgaaacttatgtgcctaaggagtttcaggctgaaacattcacctttcacgccgatatctgcactctgtccgagaaagaaaggc agattaagaaacagacagcactggtcgagctcgtgaagcataaaccaaaggctaccaaggagcagctgaaagccgtcatggacgatttcgca gcttttgtggaaaagtgttgcaaagccgacgataaggagacttgtttcgcagaagaggggaaaaagctcgtggctgccagccaggcagctctg ggtctggcagctgcccatcaccaccatcatcat |
| 809T | | |
| SEQ ID NO: 289 | 809T | QVQLVESGGGLVQPGGSLRLSCAASGFTFSDYVMNWVRQAPGKGLEWVAGISWSGVNTHYADSVKGRFTISRD NSKNTLYLQMNSLRAEDTAVYYCARLGATANNIRYKFMDVWGQGTLVTVSSGGGGSGGGGSGGGGSGGGGSD IELTQPPSVSVAPGQTARISCSGDSLRNKVYWYQQKPGQAPVLVIYKNNRPSGIPERFSGSNSGNTATLTISGTQAE DEADYYCQSYDGQKSLVFGGGTKLTVLAASDAHKSEVAHRFKDLGEENFKALVLIAFAQYLQQSPFEDHVKLVNEV TEFAKTCVADESAENCDKSLHTLFGDKLCTVATLRETYGEMADCCAKQEPERNECFLQHKDDNPNLPRLVRPEVD |

TABLE 2-continued

Examples of LRP6 constructs

| SEQ ID NUMBER | Construct | Sequence |
|---|---|---|
| | | VMCTAFHDNEETFLKKYLYEIARRHPYFYAPELLFFAKRYKAAFTECCQAADKAACLLPKLDELRDEGKASSAKQRLK<br>CASLQKFGERAFKAWAVARLSQRFPKAEFAEVSKLVTDLTKVHTECCHGDLLECADDRADLAKYICENQDSISSKLK<br>ECCEKPLLEKSHCIAEVENDEMPADLPSLAADFVESKDVCKNYAEAKDVFLGMFLYEYARRHPDYSVVLLLRLAKTY<br>ETTLEKCCAAADPHECYAKVFDEFKPLVEEPQNLIKQNCELFEQLGEYKFQNALLVRYTKKVPQVSTPTLVEVSRNL<br>GKVGSKCCKHPEAKRMPCAEDYLSVVLNQLCVLHEKTPVSDRVTKCCTESLVNRRPCFSALEVDETYVPKEFQAETF<br>TFHADICTLSEKERQIKKQTALVELVKHKPKATKEQLKAVMDDFAAFVEKCCKADDKETCFAEEGKKLVAASQAAL<br>GLAAAENLYFQGSHHHHHH |
| SEQ ID NO: 290 | 809T DNA | caggttcaattggttgaaagcggtggtggtctggttcagcctggtggtagcctgcgtctgagctgtgcagcaagcggttttacctttagcgattatg<br>tgatgaattgggttcgtcaggcaccgggtaaaggtctggaatgggttgccggtattagctggtcaggtgttaatacccattatgcagatagcgtg<br>aaaggtcgttttaccattagccgtgataatagcaaaaataccctgtatctgcagatgaatagcctgcgtgcagaagataccgcagtttattattgt<br>gcacgtctgggtgcaaccgcaaataatattcgctataaatttatggatgtgtggggtcagggtacactagttaccgttagcagtggtggtggcgg<br>cagcggcggtggcggttccggcggtggtggcagcggtggtggtggtagcgatatcgaactgacccagcctccgagcgttagcgttgcaccgggt<br>cagaccgcacgtattagctgtagcggtgatagtctgcgtaataaagtttattggtatcagcagaaaccgggtcaggctccggttctggttatttat<br>aaaaataatcgtccgagcggtattccggaacgttttagcggtagcaatagcggtaataccgcaaccctgaccattagcggcacccaggcagaa<br>gatgaagccgattattattgtcagagctatgatggtcagaaaagcctggtttttggtggtggcaccaagcttaccgttctggcggcgagcgacgct<br>cacaagagcgaagtggcacataggttcaaagatctgggcgaagagaactttaaggccctcgtcctgatcgctttcgcacagtacctccagcagt<br>ctccctttgaagatcacgtgaaactggtcaatgaggtgaccgaatttgccaagacatgcgtggctgatgagagtgcagaaaactgtgacaaatc<br>actgcatactctctttggagataagctgtgcaccgtcgccacactcagagagacttatggggaaatggctgactgttgcgcaaaacaggagcct<br>gaacggaatgagtgtttcctccagcacaaggatgacaacccaaatctgccccgcctcgtgcgacctgaggtcgatgtgatgtgcaccgcctttca<br>tgacaacgaagagacattcctgaagaaatacctgtatgaaattgctcgtaggcacccatacttttatgcccccgagctcctgttctttgcaaagag<br>atacaaagctgccttcactgaatgttgccaggcagctgataaggccgcatgtctcctgcctaaactggacgagctccgggatgaaggtaaggctt<br>ccagcgccaaacagcgcctgaagtgcgcttctctccagaagtttggcgagcgagcattcaaagcctgggctgtggcccgtctcagtcagaggttt<br>ccaaaggcagaatttgctgaggtctcaaaactggtgaccgacctcacaaaggtccatactgagtgttgccacggagatctgctggaatgtgccg<br>acgatagagcagacctcgctaaatatatctgcgagaatcaggattccattagctctaagctgaaagaatgttgcgagaagcccctcctggaaaa<br>gagtcattgtatcgccgaggtggaaaacgacgagatgccagcagatctgccatcactcgctgccgactttgtggaatccaaagatgtctgcaag<br>aattacgcagaggctaaagacgtgttcctggggatgtttctgtatgagtacgcccggcgtcaccccgattatagcgtcgtgctcctgctccgactg<br>gcaaagacctacgaaacaactctggagaaatgttgcgctgccgcagaccctcatgaatgttatgctaaggtgttcgatgagtttaagccactcgt<br>cgaagagccccagaacctgattaaacagaattgcgaactgttcgagcagctcggtgaatacaagtttcagaacgccctgctcgtgcgttatacc<br>aaaaaggtccctcaggtgtctacaccaactctggtggaggtcagtaggaatctgggcaaagtgggatcaaagtgttgcaaacaccccgaggca<br>aagagaatgccttgtgctgaagattacctctccgtcgtgctgaaccagctctgcgtgctgcatgaaaagaccccagtcagcgatcgggtgacaa<br>aatgttgcaccgaatctctggtcaatcgccgaccctgtttcagtgccctcgaagtggacgaaacttatgtgcctaaggagtttcaggctgaaacat<br>tcacctttcacgccgatatctgcactctgtccgagaaagaaaggcagattaagaaacagacagcactggtcgagctcgtgaagcataaaccaa<br>aggctaccaaggagcagctgaaagccgtcatggacgatttcgcagcttttgtggaaaagtgttgcaaagccgacgataaggagacttgtttcgc<br>agaagaggggaaaaagctcgtggctgccagccaggcagctctgggtctggcggccgcagagaacctgtattttcagggtagccaccatcatca<br>ccatcac |
| 810T | | |
| SEQ ID NO: 291 | 810T | DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKGGGGSGGGGSGGGGSGGGGSQVQLKESGPALVKPTQTLTLTCTFS<br>GFSLSNRGGGVGWIRQPPGKALEWLAWIDWDDDKSYSTSLKTRLTISKDTSKNQVVLTMTNMDPVDTATYYCAR<br>FHLPLVFDSWGQGTLVTVSSAASDAHKSEVAHRFKDLGEENFKALVLIAFAQYLQQSPFEDHVKLVNEVTEFAKTC<br>VADESAENCDKSLHTLFGDKLCTVATLRETYGEMADCCAKQEPERNECFLQHKDDNPNLPRLVRPEVDVMCTAF<br>HDNEETFLKKYLYEIARRHPYFYAPELLFFAKRYKAAFTECCQAADKAACLLPKLDELRDEGKASSAKQRLKCASLQK<br>FGERAFKAWAVARLSQRFPKAEFAEVSKLVTDLTKVHTECCHGDLLECADDRADLAKYICENQDSISSKLKECCEKP<br>LLEKSHCIAEVENDEMPADLPSLAADFVESKDVCKNYAEAKDVFLGMFLYEYARRHPDYSVVLLLRLAKTYETTLEKC<br>CAAADPHECYAKVFDEFKPLVEEPQNLIKQNCELFEQLGEYKFQNALLVRYTKKVPQVSTPTLVEVSRNLGKVGSKC |

TABLE 2-continued

Examples of LRP6 constructs

| SEQ ID NUMBER | Construct | Sequence |
| --- | --- | --- |
| | | CKHPEAKRMPCAEDYLSVVLNQLCVLHEKTPVSDRVTKCCTESLVNRRPCFSALEVDETYVPKEFQAETFTFHADIC<br>TLSEKERQIKKQTALVELVKHKPKATKEQLKAVMDDFAAFVEKCCKADDKETCFAEEGKKLVAASQAALGLAAAEN<br>LYFQGSHHHHHH |
| SEQ ID NO: 292 | 810T DNA | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>tacccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc<br>cgtggacaccgccacctattattgcgcccggtttcatctgccccctggtgttcgatagctggggccagggaaccctggtgacagtgtccagcgcgg<br>cgagcgacgctcacaagagcgaagtggcacataggttcaaagatctgggcgaagagaactttaaggccctcgtcctgatcgctttcgcacagta<br>cctccagcagtctccctttgaagatcacgtgaaactggtcaatgaggtgaccgaatttgccaagacatgcgtggctgatgagagtgcagaaaac<br>tgtgacaaatcactgcatactctctttggagataagctgtgcaccgtcgccacactcagagagacttatggggaaatggctgactgttgcgcaaa<br>acaggagcctgaacggaatgagtgtttcctccagcacaaggatgacaacccaaatctgccccgcctcgtgcgacctgaggtcgatgtgatgtgc<br>accgcctttcatgacaacgaagagacattcctgaagaaatacctgtatgaaattgctcgtaggcacccatacttttatgcccccgagctcctgttc<br>tttgcaaagagatacaaagctgccttcactgaatgttgccaggcagctgataaggccgcatgtctcctgcctaaactggacgagctccgggatga<br>aggtaaggcttccagcgccaaacagcgcctgaagtgcgcttctctccagaagtttggcgagcgagcattcaaagcctgggctgtggcccgtctc<br>agtcagaggtttccaaaggcagaatttgctgaggtctcaaaactggtgaccgacctcacaaaggtccatactgagtgttgccacggagatctgct<br>ggaatgtgccgacgatagagcagacctcgctaaatatatctgcgagaatcaggattccattagctctaagctgaaagaatgttgcgagaagccc<br>ctcctggaaaagagtcattgtatcgccgaggtggaaaacgacgagatgccagcagatctgccatcactcgctgccgactttgtggaatccaaag<br>atgtctgcaagaattacgcagaggctaaagacgtgttcctggggatgtttctgtatgagtacgcccggcgtcaccccgattatagcgtcgtgctcc<br>tgctccgactggcaaagacctacgaaacaactctggagaaatgttgcgctgccgcagaccctcatgaatgttatgctaaggtgttcgatgagttt<br>aagccactcgtcgaagagccccagaacctgattaaacagaattgcgaactgttcgagcagctcggtgaatacaagtttcagaacgccctgctcg<br>tgcgttataccaaaaaggtccctcaggtgtctacaccaactctggtggaggtcagtaggaatctgggcaaagtgggatcaaagtgttgcaaaca<br>ccccgaggcaaagagaatgccttgtgctgaagattacctctccgtcgtgctgaaccagctctgcgtgctgcatgaaaagaccccagtcagcgat<br>cgggtgacaaaatgttgcaccgaatctctggtcaatcgccgaccctgtttcagtgccctcgaagtggacgaaacttatgtgcctaaggagtttca<br>ggctgaaacattcacctttcacgccgatatctgcactctgtccgagaaagaaaggcagattaagaaacagacagcactggtcgagctcgtgaa<br>gcataaaccaaaggctaccaaggagcagctgaaagccgtcatggacgatttcgcagcttttgtggaaaagtgttgcaaagccgacgataagga<br>gacttgtttcgcagaagaggggaaaaagctcgtggctgccagccaggcagctctgggtctggcggccgcagagaacctgtattttcagggtagc<br>caccatcatcaccatcac |
| 801TF | | |
| SEQ ID NO: 293 | 801TF | QVQLVESGGGLVQPGGSLRLSCAASGFTFSDYVMNWVRQAPGKGLEWVAGISWSGVNTHYADSVKGRFTISRD<br>NSKNTLYLQMNSLRAEDTAVYYCARLGATANNIRYKFMDVWGQGTLVTVSSGGGGSGGGGSGGGGSGGGGSS<br>YELTQPPSVSVAPGQTARISCSGDSLRNKVYWYQQKPGQAPVLVIYKNNRPSGIPERFSGSNSGNTATLTISGTQAE<br>DEADYYCQSYDGQKSLVFGGGTKLTVLDAHKSEVAHRFKDLGEENFKALVLIAFAQYLQQSPFEDHVKLVNEVTEF<br>AKTCVADESAENCDKSLHTLFGDKLCTVATLRETYGEMADCCAKQEPERNECFLQHKDDNPNLPRLVRPEVDVM<br>CTAFHDNEETFLKKYLYEIARRHPYFYAPELLFFAKRYKAAFTECCQAADKAACLLPKLDELRDEGKASSAKQRLKCA<br>SLQKFGERAFKAWAVARLSQRFPKAEFAEVSKLVTDLTKVHTECCHGDLLECADDRADLAKYICENQDSISSKLKEC<br>CEKPLLEKSHCIAEVENDEMPADLPSLAADFVESKDVCKNYAEAKDVFLGMFLYEYARRHPDYSVVLLLRLAKTYET<br>TLEKCCAAADPHECYAKVFDEFKPLVEEPQNLIKQNCELFEQLGEYKFQNALLVRYTKKVPQVSTPTLVEVSRNLGK<br>VGSKCCKHPEAKRMPCAEDYLSVVLNQLCVLHEKTPVSDRVTKCCTESLVNRRPCFSALEVDETYVPKEFQAETFTF<br>HADICTLSEKERQIKKQTALVELVKHKPKATKEQLKAVMDDFAAFVEKCCKADDKETCFAEEGKKLVAASQAALGL<br>DIVLTQSPATLSLSPGERATLSCRASQFIGSRYLAWYQQKPGQAPRLLIYGASNRATGVPARFSGSGSGTDFTLTISSL<br>EPEDFATYYCQQYYDYPQTFGQGTKVEIKGGGGSGGGGSGGGGSGGGGSQVQLKESGPALVKPTQTLTLTCTFS |

TABLE 2-continued

| Examples of LRP6 constructs | | |
|---|---|---|
| SEQ ID NUMBER | Construct | Sequence |
| | | GFSLSNRGGGVGWIRQPPGKALEWLAWIDWDDDKSYSTSLKTRLTISKDTSKNQVVLTMTNMDPVDTATYYCAR FHLPLVFDSWGQGTLVTVSSAAA |
| SEQ ID NO: 294 | 801TF DNA | caggttcaattggttgaaagcggtggtggtctggttcagcctggtggtagcctgcgtctgagctgtgcagcaagcggttttacctttagcgattatg tgatgaattgggttcgtcaggcaccgggtaaaggtctggaatgggttgccggtattagctggtcaggtgttaatacccattatgcagatagcgtg aaaggtcgttttaccattagccgtgataatagcaaaaataccctgtatctgcagatgaatagcctgcgtgcagaagataccgcagtttattattgt gcacgtctgggtgcaaccgcaaataatattcgctataaatttatggatgtgtggggtcagggtacactagttaccgttagcagtggtggtggcgg cagcggcggtggcggttccggcggtggtggcagcggtggtggtggtagctcttacgaactgacccagcctccgagcgttagcgttgcaccgggt cagaccgcacgtattagctgtagcggtgatagtctgcgtaataaagtttattggtatcagcagaaaccgggtcaggctccggttctggttatttat aaaaataatcgtccgagcggtattccggaacgttttagcggtagcaatagcggtaataccgcaaccctgaccattagcggcacccaggcagaa gatgaagccgattattattgtcagagctatgatggtcagaaaagcctggtttttggtggtggcaccaagcttaccgttctggacgctcacaagag cgaagtggcacataggttcaaagatctgggcgaagagaactttaaggccctcgtcctgatcgctttcgcacagtacctccagcagtctccctttg aagatcacgtgaaactggtcaatgaggtgaccgaatttgccaagacatgcgtggctgatgagagtgcagaaaactgtgacaaatcactgcata ctctctttggagataagctgtgcaccgtcgccacactcagagagacttatggggaaatggctgactgttgcgcaaaacaggagcctgaacggaa tgagtgtttcctccagcacaaggatgacaacccaaatctgccccgcctcgtgcgacctgaggtcgatgtgatgtgcaccgcctttcatgacaacg aagagacattcctgaagaaatacctgtatgaaattgctcgtaggcacccatacttttatgcccccgagctcctgttctttgcaaagagatacaaa gctgccttcactgaatgttgccaggcagctgataaggccgcatgtctcctgcctaaactggacgagctccgggatgaaggtaaggcttccagcgc caaacagcgcctgaagtgcgcttctctccagaagtttggcgagcgagcattcaaagcctgggctgtggcccgtctcagtcagaggtttccaaagg cagaatttgctgaggtctcaaaactggtgaccgacctcacaaaggtccatactgagtgttgccacggagatctgctggaatgtgccgacgatag agcagacctcgctaaatatatctgcgagaatcaggattccattagctctaagctgaaagaatgttgcgagaagcccctcctggaaaagagtcat tgtatcgccgaggtggaaaacgacgagatgccagcagatctgccatcactcgctgccgactttgtggaatccaaagatgtctgcaagaattacg cagaggctaaagacgtgttcctggggatgtttctgtatgagtacgcccggcgtcaccccgattatagcgtcgtgctcctgctccgactggcaaag acctacgaaacaactctggagaaatgttgcgctgccgcagaccctcatgaatgttatgctaaggtgttcgatgagtttaagccactcgtcgaaga gccccagaacctgattaaacagaattgcgaactgttcgagcagctcggtgaatacaagtttcagaacgccctgctcgtgcgttataccaaaaag gtccctcaggtgtctacaccaactctggtggaggtcagtaggaatctgggcaaagtgggatcaaagtgttgcaaacaccccgaggcaaagaga atgccttgtgctgaagattacctctccgtcgtgctgaaccagctctgcgtgctgcatgaaaagaccccagtcagcgatcgggtgacaaaatgttg caccgaatctctggtcaatcgccgaccctgtttcagtgccctcgaagtggacgaaacttatgtgcctaaggagtttcaggctgaaacattcacctt tcacgccgatatctgcactctgtccgagaaagaaaggcagattaagaaacagacagcactggtcgagctcgtgaagcataaaccaaaggctac caaggagcagctgaaagccgtcatggacgatttcgcagcttttgtggaaaagtgttgcaaagccgacgataaggagacttgtttcgcagaaga ggggaaaaagctcgtggctgccagccaggcagctctgggtctggatatcgtgctgacacagagccctgccaccctgtctctgagccctggcgag agagccaccctgagctgccgggccagccagttcatcggctcccgctacctggcctggtatcagcagaagcccggacaggctcccagactgctga tctacggcgccagcaacagagctaccggcgtgcccgccagattttctggcagcggcagcggcaccgacttcaccctgaccatcagcagcctgga acccgaggacttcgccacctactactgccagcagtactacgactacccccagaccttcggccagggcaccaaggtggagatcaagggcggagg cggaagcgggggtggcggaagtggaggcggaggaagcggagggggcggaagccaggtgcaattgaaagagtccggccctgccctggtgaa gcctacccagaccctgaccctgacatgcaccttcagcggcttcagcctgagcaacagaggcggcggagtgggctggatcagacagcctcccgg caaggccctggaatggctggcctggatcgactgggacgacgacaagagctacagcaccagcctgaaaacccggctgaccatctccaaggaca ccagcaagaaccaggtggtgctcaccatgaccaacatggaccccgtggacaccgccacctattattgcgcccggtttcatctgcccctggtgttc gatagctggggccagggaaccctggtgacagtgtccagcgcggccgca |
| 802TF | | |
| SEQ ID NO: 295 | 802TF | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKGGGGSGGGGSGGGGSGGGGSQVQLKESGPALVKPTQTLTLTCTFS GFSLSNRGGGVGWIRQPPGKALEWLAWIDWDDDKSYSTSLKTRLTISKDTSKNQVVLTMTNMDPVDTATYYCAR FHLPLVFDSWGQGTLVTVSSDAHKSEVAHRFKDLGEENFKALVLIAFAQYLQQSPFEDHVKLVNEVTEFAKTCVAD ESAENCDKSLHTLFGDKLCTVATLRETYGEMADCCAKQEPERNECFLQHKDDNPNLPRLVRPEVDVMCTAFHDN EETFLKKYLYEIARRHPYFYAPELLFFAKRYKAAFTECCQAADKAACLLPKLDELRDEGKASSAKQRLKCASLQKFGER AFKAWAVARLSQRFPKAEFAEVSKLVTDLTKVHTECCHGDLLECADDRADLAKYICENQDSISSKLKECCEKPLLEKS |

TABLE 2-continued

| SEQ ID NUMBER | Construct | Sequence |
|---|---|---|
| | | HCIAEVENDEMPADLPSLAADFVESKDVCKNYAEAKDVFLGMFLYEYARRHPDYSVVLLLRLAKTYETTLEKCCAAA DPHECYAKVFDEFKPLVEEPQNLIKQNCELFEQLGEYKFQNALLVRYTKKVPQVSTPTLVEVSRNLGKVGSKCCKHP EAKRMPCAEDYLSVVLNQLCVLHEKTPVSDRVTKCCTESLVNRRPCFSALEVDETYVPKEFQAETFTFHADICTLSEK ERQIKKQTALVELVKHKPKATKEQLKAVMDDFAAFVEKCCKADDKETCFAEEGKKLVAASQAALGLQVQLVESGG GLVQPGGSLRLSCAASGFTFSDYVMNWVRQAPGKGLEWVAGISWSGVNTHYADSVKGRFTISRDNSKNTLYLQ MNSLRAEDTAVYYCARLGATANNIRYKFMDVWGQGTLVTVSSGGGGSGGGGSGGGGSGGGGSSYELTQPPSVS VAPGQTARISCSGDSLRNKVYWYQQKPGQAPVLVIYKNNRPSGIPERFSGSNSGNTATLTISGTQAEDEADYYCQS YDGQKSLVFGGGTKLTVLAAA |
| SEQ ID NO: 296 | 802TF DNA | gatatcgtgctgacacagagccctgccaccctgtctctgagccctggcgagagagccaccctgagctgccgggccagccagttcatcggctccc gctacctggcctggtatcagcagaagcccggacaggctcccagactgctgatctacggcgccagcaacagagctaccggcgtgcccgccagatt ttctggcagcggcagcggcaccgacttcaccctgaccatcagcagcctggaacccgaggacttcgccacctactactgccagcagtactacgac taccccagaccttcggccagggcaccaaggtggagatcaagggcggaggcggaagcgggggtggcggaagtggaggcggaggaagcgga gggggcggaagccaggtgcaattgaaagagtccggccctgccctggtgaagcctacccagaccctgaccctgacatgcaccttcagcggcttca gcctgagcaacagaggcggcggagtgggctggatcagacagcctcccggcaaggccctggaatggctggcctggatcgactgggacgacgac aagagctacagcaccagcctgaaaacccggctgaccatctccaaggacaccagcaagaaccaggtggtgctcaccatgaccaacatggaccc cgtggacaccgccacctattattgcgcccggtttcatctgcccctggtgttcgatagctggggccagggaaccctggtgacagtgtccagcgacg ctcacaagagcgaagtggcacataggttcaaagatctgggcgaagagaactttaaggccctcgtcctgatcgctttcgcacagtacctccagca gtctccctttgaagatcacgtgaaactggtcaatgaggtgaccgaatttgccaagacatgcgtggctgatgagagtgcagaaaactgtgacaaa tcactgcatactctctttggagataagctgtgcaccgtcgccacactcagagagacttatggggaaatggctgactgttgcgcaaaacaggagcc tgaacggaatgagtgtttcctccagcacaaggatgacaacccaaatctgccccgcctcgtgcgacctgaggtcgatgtgatgtgcaccgcctttc atgacaacgaagagacattcctgaagaaatacctgtatgaaattgctcgtaggcacccatacttttatgcccccgagctcctgttctttgcaaaga gatacaaagctgccttcactgaatgttgccaggcagctgataaggccgcatgtctcctgcctaaactggacgagctccgggatgaaggtaaggc ttccagcgccaaacagcgcctgaagtgcgcttctctccagaagtttggcgagcgagcattcaaagcctgggctgtggcccgtctcagtcagaggt ttccaaaggcagaatttgctgaggtctcaaaactggtgaccgacctcacaaaggtccatactgagtgttgccacggagatctgctggaatgtgcc gacgatagagcagacctcgctaaatatatctgcgagaatcaggattccattagctctaagctgaaagaatgttgcgagaagcccctcctggaaa agagtcattgtatcgccgaggtggaaaacgacgagatgccagcagatctgccatcactcgctgccgactttgtggaatccaaagatgtctgcaa gaattacgcagaggctaaagacgtgttcctggggatgtttctgtatgagtacgcccggcgtcaccccgattatagcgtcgtgctcctgctccgact ggcaaagacctacgaaacaactctggagaaatgttgcgctgccgcagaccctcatgaatgttatgctaaggtgttcgatgagtttaagccactcg tcgaagagccccagaacctgattaaacagaattgcgaactgttcgagcagctcggtgaatacaagtttcagaacgccctgctcgtgcgttatacc aaaaaggtccctcaggtgtctacaccaactctggtggaggtcagtaggaatctgggcaaagtgggatcaaagtgttgcaaacaccccgaggca aagagaatgccttgtgctgaagattacctctccgtcgtgctgaaccagctctgcgtgctgcatgaaaagaccccagtcagcgatcgggtgacaa aatgttgcaccgaatctctggtcaatcgccgaccctgtttcagtgccctcgaagtggacgaaacttatgtgcctaaggagtttcaggctgaaacat tcacctttcacgccgatatctgcactctgtccgagaaagaaaggcagattaagaaacagacagcactggtcgagctcgtgaagcataaaccaa aggctaccaaggagcagctgaaagccgtcatggacgatttcgcagcttttgtggaaaagtgttgcaaagccgacgataaggagacttgtttcgc agaagaggggaaaaagctcgtggctgccagccaggcagctctgggtctgcaggttcaattggttgaaagcggtggtggtctggttcagcctggt ggtagcctgcgtctgagctgtgcagcaagcggttttacctttagcgattatgtgatgaattgggttcgtcaggcaccgggtaaaggtctggaatgg gttgccggtattagctggtcaggtgttaatacccattatgcagatagcgtgaaaggtcgttttaccattagccgtgataatagcaaaaataccctg tatctgcagatgaatagcctgcgtgcagaagataccgcagtttattattgtgcacgtctgggtgcaaccgcaaataatattcgctataaatttatg gatgtgtggggtcagggtacactagttaccgttagcagtggtggtggcggcagcggcggtggcggttccggcggtggtggcagcggtggtggtg gtagctcttacgaactgacccagcctccgagcgttagcgttgcaccgggtcagaccgcacgtattagctgtagcggtgatagtctgcgtaataaa gtttattggtatcagcagaaaccgggtcaggctccggttctggttatttataaaaataatcgtccgagcggtattccggaacgttttagcggtagc |

TABLE 2-continued

Examples of LRP6 constructs

| SEQ ID NUMBER | Construct | Sequence |
|---|---|---|
| | | aatagcggtaataccgcaaccctgaccattagcggcacccaggcagaagatgaagccgattattattgtcagagctatgatggtcagaaaagc ctggtttttggtggtggcaccaagcttaccgttctggcggccgca |
| 911T | | |
| SEQ ID NO: 297 | 911T | QVQLVESGGGLVQPGGSLRLSCAASGFTFSDYVMNWVRQAPGKGLEWVAGISWSGVNTHYADSVKGRFTISRD NSKNTLYLQMNSLRAEDTAVYYCARLGATANNIRYKFMDVWGQGTLVTVSSGGGGSGGGGSGGGGSGGGGSD IELTQPPSVSVAPGQTARISCSGDSLRNKVYWYQQKPGQAPVLVIYKNNRPSGIPERFSGSNSGNTATLTISGTQAE DEADYYCQSYDGQKSLVFGGGTKLTVLDKTHTCPPCPAPEAAGGPSVFLFPPKPKDTLMISRTPEVTCVVVDVSHE DPEVKFNWYVDGVEVHNAKTKPREEQYNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFLYSKLTVDKSRWQQ GNVFSCSVMHEALHNHYTQKSLSLSPGKGGGGSGGGGSGGGGSDIVLTQSPATLSLSPGERATLSCRASQFIGSRY LAWYQQKPGQAPRLLIYGASNRATGVPARFSGSGSGTDFTLTISSLEPEDFATYYCQQYYDYPQTFGQGTKVEIKG GGGSGGGGSGGGGSGGGGSQVQLKESGPALVKPTQTLTLTCTFSGFSLSNRGGGVGWIRQPPGKALEWLAWID WDDDKSYSTSLKTRLTISKDTSKNQVVLTMTNMDPVDTATYYCARFHLPLVFDSWGQGTLVTVSS |
| SEQ ID NO: 298 | 911T DNA | caggttcaattggttgaaagcggtggtggtctggttcagcctggtggtagcctgcgtctgagctgtgcagcaagcggttttacctttagcgattatg tgatgaattgggttcgtcaggcaccgggtaaaggtctggaatgggttgccggtattagctggtcaggtgttaatacccattatgcagatagcgtg aaaggtcgttttaccattagccgtgataatagcaaaaataccctgtatctgcagatgaatagcctgcgtgcagaagataccgcagtttattattgt gcacgtctgggtgcaaccgcaaataatattcgctataaatttatggatgtgtggggtcagggtacactagttaccgttagcagtggtggtggcgg cagcggcggtggcggttccggcggtggtggcagcggtggtggtggtagcgatatcgaactgacccagcctccgagcgttagcgttgcaccgggt cagaccgcacgtattagctgtagcggtgatagtctgcgtaataaagtttattggtatcagcagaaaccgggtcaggctccggttctggttatttat aaaaataatcgtccgagcggtattccggaacgttttagcggtagcaatagcggtaataccgcaaccctgaccattagcggcacccaggcagaa gatgaagccgattattattgtcagagctatgatggtcagaaaagcctggtttttggtggtggcaccaagcttaccgttctggacaagacccacac ctgccccccctgcccagccccagaggcagcgggcggaccctccgtgttcctgttccccccaagcccaaggacaccctgatgatcagcaggacc cccgaggtgacctgcgtggtggtggacgtgagccacgaggacccagaggtgaagttcaactggtacgtggacggcgtggaggtgcacaacgcc aagaccaagcccagagaggagcagtacaacagcacctacagggtggtgtccgtgctgaccgtgctgcaccaggactggctgaacggcaagga atacaagtgcaaggtctccaacaaggccctgccagcccccatcgaaaagaccatcagcaaggccaagggccagccacgggagccccaggtgt acaccctgcccccctcccgggaggagatgaccaagaaccaggtgtccctgacctgtctggtgaagggcttctaccccagcgacatcgccgtgga gtgggagagcaacggccagcccgagaacaactacaagaccacccccccagtgctggacagcgacggcagcttcttcctgtacagcaagctga ccgtggacaagtccaggtggcagcagggcaacgtgttcagctgcagcgtgatgcacgaagcgctgcacaaccactacacccagaagagcctg agcctgtcccccggcaagggaggtggcgggagtggtggagggggctcaggcgggggtggatctgatatcgtgctgacacagagccctgccacc ctgtctctgagccctggcgagagagccaccctgagctgccgggccagccagttcatcggctcccgctacctggcctggtatcagcagaagcccg gacaggctcccagactgctgatctacggcgccagcaacagagctaccggcgtgcccgccagattttctggcagcggcagcggcaccgacttcac cctgaccatcagcagcctggaacccgaggacttcgccacctactactgccagcagtactacgactacccccagaccttcggccagggcaccaag gtggagatcaagggcggaggcggatccgggggtggcggaagtggaggcggaggaagcggagggggcggaagccaggtgcaattgaaagag tccggccctgccctggtgaagcctacccagaccctgaccctgacatgcaccttcagcggcttcagcctgagcaacagaggcggcggagtgggct ggatcagacagcctcccggcaaggccctggaatggctggcctggatcgactgggacgacgacaagagctacagcaccagcctgaaaacccgg ctgaccatctccaaggacaccagcaagaaccaggtggtgctcaccatgaccaacatggaccccgtggacaccgccacctattattgcgcccggt ttcatctgccccctggtgttcgatagctggggccagggaaccctggtgacagtgtccagc |
| 912T | | |
| SEQ ID NO: 299 | 912T | DIVLTQSPATLSLSPGERATLSCRASQFIGSRYLAWYQQKPGQAPRLLIYGASNRATGVPARFSGSGSGTDFTLTISSL EPEDFATYYCQQYYDYPQTFGQGTKVEIKGGGGSGGGGSGGGGSGGGGSQVQLKESGPALVKPTQTLTLTCTFS GFSLSNRGGGVGWIRQPPGKALEWLAWIDWDDDKSYSTSLKTRLTISKDTSKNQVVLTMTNMDPVDTATYYCAR FHLPLVFDSWGQGTLVTVSSDKTHTCPPCPAPEAAGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIEKTISKAKGQPREPQVYTL |

TABLE 2-continued

Examples of LRP6 constructs

| SEQ ID NUMBER | Construct | Sequence |
|---|---|---|
| | | PPSREEMTKNQVSLTCLVKGFYPSDIAVEWESNGQPENNYKTTPPVLDSDGSFFLYSKLTVDKSRWQQGNVFSCS<br>VMHEALHNHYTQKSLSLSPGKGGGGSGGGGSGGGGSQVQLVESGGGLVQPGGSLRLSCAASGFTFSDYVMNW<br>VRQAPGKGLEWVAGISWSGVNTHYADSVKGRFTISRDNSKNTLYLQMNSLRAEDTAVYYCARLGATANNIRYKF<br>MDVWGQGTLVTVSSGGGGSGGGGSGGGGSGGGGSDIELTQPPSVSVAPGQTARISCSGDSLRNKVYWYQQKP<br>GQAPVLVIYKNNRPSGIPERFSGSNSGNTATLTISGTQAEDEADYYCQSYDGQKSLVFGGGTKLTVL |
| SEQ ID NO: 300 | 912T DNA | gatatcgtgctgacacagagccctgccaccctgtctctgagccctggcgagagagccaccctgagctgccgggccagccagttcatcggctccc<br>gctacctggcctggtatcagcagaagcccggacaggctcccagactgctgatctacggcgccagcaacagagctaccggcgtgcccgccagatt<br>ttctggcagcggcagcggcaccgacttcaccctgaccatcagcagcctggaacccgaggacttcgccacctactactgccagcagtactacgac<br>tacccccagaccttcggccagggcaccaaggtggagatcaagggcggaggcggaagcgggggtggcggaagtggaggcggaggaagcgga<br>gggggcggaagccaggtgcaattgaaagagtccggccctgccctggtgaagcctacccagaccctgaccctgacatgcaccttcagcggcttca<br>gcctgagcaacagaggcggcggagtgggctggatcagacagcctcccggcaaggccctggaatggctggcctggatcgactgggacgacgac<br>aagagctacagcaccagcctgaaaacccggctgaccatctccaaggacaccagcaagaaccaggtggtgctcaccatgaccaacatggaccc<br>cgtggacaccgccacctattattgcgcccggtttcatctgcccctggtgttcgatagctggggccagggaaccctggtgacagtgtccagcgaca<br>agacccacacctgccccccctgcccagccccagaggcagcgggcggaccctccgtgttcctgttcccccccaagcccaaggacaccctgatgat<br>cagcaggacccccgaggtgacctgcgtggtggtggacgtgagccacgaggacccagaggtgaagttcaactggtacgtggacggcgtggagg<br>tgcacaacgccaagaccaagcccagagaggagcagtacaacagcacctacagggtggtgtccgtgctgaccgtgctgcaccaggactggctg<br>aacggcaaggaatacaagtgcaaggtctccaacaaggccctgccagcccccatcgaaaagaccatcagcaaggccaagggccagccacggg<br>agccccaggtgtacaccctgcccccctcccgggaggagatgaccaagaaccaggtgtccctgacctgtctggtgaagggcttctaccccagcga<br>catcgccgtggagtgggagagcaacggccagcccgagaacaactacaagaccacccccccagtgctggacagcgacggcagcttcttcctgta<br>cagcaagctgaccgtggacaagtccaggtggcagcagggcaacgtgttcagctgcagcgtgatgcacgaagcgctgcacaaccactacaccc<br>agaagagcctgagcctgtcccccggcaagggaggtggcgggagtggtggagggggctcaggcgggggtggatctcaggttcaattggttgaa<br>agcggtggtggtctggttcagcctggtggtagcctgcgtctgagctgtgcagcaagcggttttacctttagcgattatgtgatgaattgggttcgtc<br>aggcaccgggtaaaggtctggaatgggttgccggtattagctggtcaggtgttaatacccattatgcagatagcgtgaaaggtcgttttaccatt<br>agccgtgataatagcaaaaataccctgtatctgcagatgaatagcctgcgtgcagaagataccgcagtttattattgtgcacgtctgggtgcaac<br>cgcaaataatattcgctataaatttatggatgtgtggggtcagggtacactagttaccgttagcagtggtggtggtggtagcggtggtggcggat<br>ctggtggcggtggttcaggtggtggtggcagtgatatcgaactgacccagcctccgagcgttagcgttgcaccgggtcagaccgcacgtattagc<br>tgtagcggtgatagtctgcgtaataaagtttattggtatcagcagaaaccgggtcaggctccggttctggttatttataaaaataatcgtccgagc<br>ggtattccggaacgttttagcggtagcaatagcggtaataccgcaaccctgaccattagcggcacccaggcagaagatgaagccgattattatt<br>gtcagagctatgatggtcagaaaagcctggtttttggtggtggcaccaagcttaccgttctg |

LRP6 constructs provide advantages over traditional antibodies for example, expanding the repertoire of targets, having new binding specificities, increased potency, and no signal potentiation. A single LRP6 construct can bind to multiple Propeller regions on a single LRP6 target receptor on the same cell, and inhibit Wnt signaling. In one embodiment, the LRP6 construct binds to any combination of a β-propeller regions selected from the group consisting of propeller 1 (P 1), propeller 2 (P2), propeller 3 (P3), and propeller 4 (P4). In one embodiment, the LRP6 construct binds to propeller 1 and propeller 3 domains of LRP6. Thus, a single LRP6 construct has increased potency of action by binding to multiple β-propeller regions and inhibiting Wnt signaling mediated by each domain. For example, a single LRP6 construct inhibits both propeller 1 and propeller 3 mediated Wnt signaling by binding to both propeller 1 and propeller 3 domains, respectively, all while avoiding potentiation of a Wnt signal.

The LRP6 constructs can bind multiple binding sites of the LRP6 receptor concurrently. The LRP6 binding moieties of the LRP6 constructs may bind at least 1, 2, 3, 4, 5, 6, 7, 8 or more binding sites of the LRP6 receptor. The LRP6 constructs can comprise one or more LRP6 binding moieties that are specific for distinct epitopes on the same LRP6 receptor, e.g., β-propeller 1 domain or β-propeller 3 domain of LRP6 receptor. Alternatively, the LRP6 constructs can comprise one or more LRP6 binding moieties that are specific for epitopes on different target receptors, e.g., LRP6 and a receptor that is not LRP6 such as Erb, cmet, IGFR1, Smoothened, and Notch receptors.

In one embodiment, two or more identical LRP6 binding moieties (i.e., moieties having the same structure and binding affinities) are linked to the half-life extender, one or more (e.g., in tandem) each at the amino and carboxy termini of the half-life extender, e.g., the HSA affording improved avidity of the binding moieties for their target antigen (e.g. scFv(P1)-scFv(P1)-HSA; scFv(P3)-scFv(P3)-HSA; HSA-scFv(P1)-scFv(P3)). Alternatively, two or more different LRP6 binding moieties (e.g., a Fab, an scFv, with binding affinities for two or more same or different target molecules (e.g., scFv(P1)-HSA-Fab(P3); scFv(P3)-HSA-Fab(P1); Fab(P1)-HSA-scFv (P3); Fab(P3)-HSA-scFv(P1))), or Fab or scFv with binding affinities for two or more different epitopes on the same target molecule can be linked to the half-life extender (e.g., scFv (P3)-HSA-scFv(P1); scFv(P1)-HSA-scFv(P3), Fab(P1)-HSA-Fab(P3), Fab(P3)-HSA-Fab(P1), scFv(P1)-scFv(P3)-HSA, scFv(P3)-scFv(P1)-HSA) Fab(P1)-Fab(P3)-HSA, Fab (P3)-Fab(P1)-HSA) to allow multiple target antigens or epitopes to be bound by the LRP6 conjugate. In another embodiment, different species of LRP6 binding moieties can also be linked to an LRP6 conjugate to bestow, for example, two or more different binding specificities or agonistic/antagonistic biological properties on the LRP6

In one embodiment, the LRP6 construct comprises a scFv that binds to the Propeller 1 region of LRP6 receptor, a half-life extender molecule (e.g., HSA), and a scFv that binds to Propeller 3 region of the LRP6 receptor. The construct is designated "801" and has the construct sequence of scFv(P1)-HSA-scFv(P3).

In one embodiment, the LRP6 construct comprises a scFv that binds to the Propeller 3 region of LRP6 receptor, a half-life extender molecule (e.g., HSA), and a scFv that binds to Propeller 1 region of the LRP6 receptor. The construct is designated "802" and has the construct sequence of scFv(P3)-HSA-scFv(P1).

In another embodiment, the LRP6 construct comprises a Fab that binds to the Propeller 1 region of LRP6 receptor, a half-life extender molecule (e.g., HSA), and a Fab that binds to Propeller 3 region of the LRP6 receptor. The construct is designated Fab(P1)-HSA-Fab(P3).

In another embodiment, the LRP6 construct comprises a scFv that binds to the Propeller 1 region of LRP6 receptor, a half-life extender molecule (e.g., HSA), and a Fab that binds to Propeller 3 region of the LRP6 receptor. The construct is designated scFv(P1)-HSA-Fab(P3).

In another embodiment, the LRP6 construct comprises a Fab that binds to the Propeller 1 region of LRP6 receptor, a half-life extender molecule (e.g., PEG), and a Fab that binds to Propeller 3 region of the LRP6 receptor. The construct is designated Fab(P1)-PEG-Fab(P3)

In another embodiment, the LRP6 construct comprises a scFv that binds to the Propeller 1 region of LRP6 receptor, a half-life extender molecule (e.g., Fc), and a scFv that binds to Propeller 3 region of the LRP6 receptor. The construct is designated scFv (P1)-Fc-scFv (P3).

LRP6 Construct Orientation

LRP6 constructs are generated in any orientation using at least one LRP6 binding moiety (e.g., a scFv, and Fab) as long as the resulting LRP6 construct retain functional activity (e.g., inhibiting Wnt signaling) and prolonged half-life. It should be understood that any number of LRP6 binding moieties can be added to the C-terminus and/or N-terminus of the half-life extender as long as the resulting LRP6 constructs retain functional activity (e.g., inhibiting Wnt signaling). In an embodiment, one, two, three, or more LRP6 binding moieties are linked to the C-terminus of the half-life extender. In other embodiments one, two, three, or more LRP6 binding moieties are linked to the N-terminus of the half-life extender. In other embodiments, one, two, three, or more LRP6 binding moieties are linked to both the N-terminus and C-terminus of the half-life extender. For example, LRP6 constructs can comprise more than LRP6 binding moiety of the same type linked to the C-terminus and/or N-terminus of the half-life extender, e.g., scFv-half-life extender-scFv. Alternatively, the LRP6 construct can comprise more than one LRP6 binding moieties of a different type linked to the C-terminus and/or N-terminus of the half-life extender, e.g., scFv-half-life extender-Fab.

LRP6 constructs with any number of permutations of LRP6 binding moieties and half-life extenders can be generated. In one embodiment, the half-life extender is HSA. In another embodiment, the half-life extender is Fc. In another embodiment, the half-life extender is PEG. These LRP6 constructs can be tested for functionality using the methods and assays described within.

The LRP6 conjugates can be characterized by various functional assays. For example, they can be characterized by their ability to inhibit biological activity by inhibiting canonical Wnt signaling in a Wnt gene assay as described herein, their affinity to a LRP6 protein (e.g., human and/or cynomologus LRP6), the epitope binning, their resistance to proteolysis, and their ability to block the Wnt pathway. In addition, the LRP6 conjugates are characterized by ability to potentiate a Wnt signal in the presence of a Wnt ligand. Various methods can be used to measure LRP6-mediated Wnt signaling. For example, the Wnt signaling pathway can be monitored by (i) measurement of abundance and localization of β-catenin; and (ii) measurement of phosphorylation of LRP6 or other downstream Wnt signaling proteins (e.g. DVL), and iii) measurement of specific gene signatures or gene targets (e.g. c-myc, Cyclin-D, Axing).

LRP6 Conjugate—Conjugates

The LRP6 conjugates can be coupled to a diagnostic or detectable agent to generate LRP6 conjugate-conjugates. Such LRP6 conjugates can be useful for monitoring or prognosing the onset, development, progression and/or severity of a disease or disorder as part of a clinical testing procedure, such as determining the efficacy of a particular therapy. Such diagnosis and detection can accomplished by coupling the LRP6 conjugates to detectable substances including, but not limited to, various enzymes, such as, but not limited to, horseradish peroxidase, alkaline phosphatase, beta-galactosidase, or acetylcholinesterase; prosthetic groups, such as, but not limited to, streptavidin/biotin and avidin/biotin; fluorescent materials, such as, but not limited to, umbelliferone, fluorescein, fluorescein isothiocynate, rhodamine, dichlorotriazinylamine fluorescein, dansyl chloride or phycoerythrin; luminescent materials, such as, but not limited to, luminol; bioluminescent materials, such as but not limited to, luciferase, luciferin, and aequorin; radioactive materials, such as, but not limited to, iodine ($^{131}$I, $^{125}$I, $^{123}$I, and $^{121}$I) carbon ($^{14}$C), sulfur ($^{35}$S), tritium ($^{3}$H), indium ($^{115}$In, $^{113}$In, $^{112}$In, and $^{111}$In), technetium ($^{99}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, 47Sc, $^{186}$Re, $^{188}$Re, $^{142}$Pr, $^{105}$Rh, $^{97}$Ru, $^{68}$Ge, $^{57}$Co, $^{65}$Zn, $^{85}$Sr, $^{32}$P, $^{153}$Gd, $^{169}$Yb, $^{51}$Cr, $^{54}$Mn, $^{75}$Se, $^{113}$Sn, and $^{117}$Tin; and positron emitting metals using various positron emission tomographies, and noradioactive paramagnetic metal ions.

The present invention further encompasses uses of LRP6 conjugates coupled to a therapeutic moiety such as a cytotoxin, e.g., a cytostatic or cytocidal agent, a therapeutic agent or a radioactive metal ion, e.g., alpha-emitters. A cytotoxin or cytotoxic agent includes any agent that is detrimental to cells.

LRP6 conjugates can be coupled to a radioactive isotope to generate cytotoxic radiopharmaceuticals, also referred to as radioimmunoconjugates. Examples of radioactive isotopes that can be conjugated to antibodies for use diagnostically or therapeutically include, but are not limited to, iodine$^{131}$, indium$^{111}$, yttrium$^{90}$, and lutetium$^{177}$. Method for preparing radioimmunconjugates are established in the art. Examples of radioimmunoconjugates are commercially available, including Zevalin™ (DEC Pharmaceuticals) and Bexxar™ (Corixa Pharmaceuticals), and similar methods can be used to prepare radioimmunoconjugates. In certain embodiments, the macrocyclic chelator is 1,4,7,10-tetraazacyclododecane-N,N',N",N'"-tetraacetic acid (DOTA) which can be attached to the LRP6 conjugates via a linker molecule. Such linker molecules are commonly known in the art and described in Denardo et al., (1998) Clin Cancer Res. 4(10):2483-90; Peterson et al., (1999) Bioconjug. Chem. 10(4):553-7; and Zimmerman et al., (1999) Nucl. Med. Biol. 26(8):943-50, each incorporated by reference in their entireties.

LRP6 Conjugate Manufacture

The LRP6 construct can be produced recombinantly. For example, a nucleotide sequence encoding the LRP6 binding moieties and the half-life extender molecule may be expressed (e.g., in a plasmid, viral vector, or transgenically) in a bacterial (e.g., *E. coli*), insect, yeast, or mammalian cell (e.g., a CHO cell), or a mammalian tissue, organ, or organism (e.g., a transgenic rodent, ungulate (e.g., a goat), or non-human primate). After expression of the LRP6 construct in the host cell, tissue, or organ, the skilled artisan may isolate and purify the LRP6 construct using standard protein purification methods (e.g., FPLC or affinity chromatography).

Alternatively, the LRP6 construct can be synthetically produced. For example, the LRP6 construct can be prepared by techniques generally established in the art of peptide synthesis, such as the solid-phase approach. Solid-phase synthesis involves the stepwise addition of amino acid residues to a growing peptide chain that is linked to an insoluble support or matrix, such as polystyrene. The C-terminus residue of the peptide is first anchored to a commercially available support with its amino group protected with an N-protecting agent such as a t-butyloxycarbonyl group (tBoc) or a fluorenylmethoxycarbonyl (FMOC) group. The amino-protecting group is removed with suitable deprotecting agents such as TFA in the case of tBOC or piperidine for FMOC and the next amino acid residue (in N-protected form) is added with a coupling agent such as dicyclocarbodiimide (DCC). Upon formation of a peptide bond, the reagents arc washed from the support. After addition of the final residue, the agent is cleaved from the support with a suitable reagent, such as trifluoroacetic acid (TFA) or hydrogen fluoride (HF). If desired, the LRP6 construct can be manufactured in one, two, three, or more segments, which can then be ligated to form the whole LRP6 construct.

Prophylactic and Therapeutic Uses

The present invention provides methods of treating a disease or disorder associated with the LRP6 Wnt signaling pathway by administering to a subject in need thereof an effective amount of the LRP6 conjugates. In a specific embodiment, the present invention provides a method of treating or preventing cancers (e.g., breast cancer, lung cancer, multiple myeloma, ovarian cancer, liver cancer, bladder cancer, gastric cancer, prostate cancer, acute myeloid leukemia, chronic myeloid leukemia, osteosarcoma, squamous cell carcinoma, and melanoma by administering to a subject in need thereof an effective amount of the LRP6 conjugates. In some embodiments, the present invention provides methods of treating or preventing cancers associated with a Wnt signaling pathway by administering to a subject in need thereof an effective amount of the LRP6 conjugates.

In one embodiment, the present invention provides methods of treating cancers associated with a Wnt signaling pathway that include, but are not limited to breast cancer, lung cancer, multiple myeloma, ovarian cancer, bladder cancer, liver cancer gastric cancer, prostate cancer, acute myeloid leukemia, chronic myeloid leukemia, osteosarcoma, squamous cell carcinoma, and melanoma.

LRP6 conjugates can also be used to treat or prevent other disorders associated with aberrant or defective Wnt signaling, including but are not limited to osteoporosis, osteoarthritis, polycystic kidney disease, diabetes, schizophrenia, vascular disease, cardiac disease, non-oncogenic proliferative diseases, fibrosis, and neurodegenerative diseases such as Alzheimer's disease. The Wnt signaling pathway plays a critical role in tissue repair and regeneration. Agents that sensitize cells to Wnt signaling can be used to promote tissue regeneration for many conditions such as bone diseases, mucositis, acute and chronic kidney injury, and others.

Suitable agents for combination treatment with LRP6 conjugates include standard of care agents known in the art that are able to modulate the activities of canonical Wnt signaling pathway (e.g., PI3 kinase agents).

Pharmaceutical Compositions

LRP6 conjugates may be administered prior to, concurrent with, or following radiotherapy or surgery. For example, a patient suffering from a proliferative disorder (e.g., breast cancer) can receive an LRP6 conjugate, alone or in combination with other therapeutic, cytotoxic, or cytotoxic agents as described herein concurrent with targeted radiotherapy or surgical intervention (e.g., lumpectomy or mastectomy) at the site of the cancerous tissue. Radiotherapies suitable for use in combination with LRP6 conjugates include brachy therapy and targeted intraoperative radiotherapy (TARGIT).

Pharmaceutical compositions provided herein contain a therapeutically or diagnostically effective amount of a LRP6 conjugate that includes one or more of a LRP6 binding moiety (e.g., antibodies or antibody fragments). The active ingredients, an LRP6 conjugate (prepared with one or more of a LRP6 binding moiety can be formulated for use in a variety of drug delivery systems. One or more physiologically acceptable excipients or carriers can also be included in the compositions for proper formulation. Suitable formulations for use in the present invention are found in Remington's Pharmaceutical Sciences, Mack Publishing Company, Philadelphia, Pa., 17th ed. (1985). For a brief review of methods for drug delivery, see, Langer Science 249:1527-1533 (1990).

The pharmaceutical compositions are intended for parenteral, intranasal, topical, oral, or local administration, such as by a transdermal means, for prophylactic and/or therapeutic treatment. Commonly, the pharmaceutical compositions are administered parenterally (e.g., by intravenous, intramuscular, or subcutaneous injection), or by oral ingestion, or by topical application. Thus, compositions for parenteral administration may include an LRP6 conjugate dissolved or suspended in an acceptable carrier, preferably an aqueous carrier, e.g., water, buffered water, saline, PBS, and the like. The compositions may contain pharmaceutically acceptable auxiliary substances as required to approximate physiological conditions, such as pH adjusting and buffering agents, tonicity adjusting agents, wetting agents, detergents and the like. The invention also provides compositions for oral delivery, which may contain inert ingredients such as binders or fillers for the formulation of a tablet, a capsule, and the like. Furthermore, this invention provides compositions for local administration, which may contain inert ingredients such as solvents or emulsifiers for the formulation of a cream, an ointment, and the like.

These compositions may be sterilized by conventional sterilization techniques, or may be sterile filtered. The resulting aqueous solutions may be packaged for use as is, or lyophilized, the lyophilized preparation being combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of an LRP6 conjugate in a sealed package of tablets or capsules, for example. The composition in solid form can also be packaged in a container for a flexible quantity, such as in a squeezable tube designed for a topically applicable cream or ointment.

The compositions containing an effective amount of an LRP6 conjugate can be administered to a mammal (e.g., a human) for prophylactic and/or therapeutic treatments. In prophylactic applications, compositions containing an LRP6 conjugate are administered to a patient susceptible to or otherwise at risk of developing a disease or condition (e.g., a cancer). Such an amount is defined to be a "prophylactically effective dose." In this use, the precise amounts again depend on the patient's state of health, but generally range from about 0.5 mg to about 400 mg of an LRP6 conjugate per dose (e.g., 10 mg, 50 mg, 100 mg, 200 mg, 300 mg, or 400 mg or more per dose) and from about 0.1 μg to about 300 mg of one or more immunomodulatory agents per dose (e.g., 10 μg, 30 μg, 50 μg, 0.1 mg, 10 mg, 50 mg, 100 mg, or 200 mg per dose). A dose of an LRP6 conjugate can be administered prophylactically to a patient one or more times per hour, day, week, month, or year (e.g., 2, 4, 5, 6, 7, 8, 9, 10, 11, or 12 times per hour, day, week, month, or year). More commonly, a single dose per week of an LRP6 conjugate is administered.

In therapeutic applications, a dose of an LRP6 conjugate is administered to a mammal (e.g., a human) already suffering from a disease or condition (e.g., a cancer, autoimmune disease, cardiovascular disease, bone, opthalmology) in an amount sufficient to cure or at least partially arrest or alleviate one or more of the symptoms of the disease or condition and its complications. An amount adequate to accomplish this purpose is defined as a "therapeutically effective dose." Amounts effective for this use may depend on the severity of the disease or condition and general state of the patient, but generally range from about 0.5 mg to about 400 mg of an LRP6 conjugate per dose (e.g., 10 mg, 50 mg, 100 mg, 200 mg, 300 mg, or 400 mg or more per dose). A dose of an LRP6 conjugate can be administered therapeutically to a patient one or more times per hour, day, week, month, or year (e.g., 2, 4, 5, 6, 7, 8, 9, 10, 11, or 12 times per hour, day, week, month, or year). More commonly, a single dose per week of an LRP6 conjugate is administered.

In several embodiments, the patient may receive an LRP6 conjugate in the range of about 0.5 to about 400 mg per dose one or more times per week (e.g., 2, 3, 4, 5, 6, or 7 or more per week), preferably about 5 mg to about 300 mg per dose one or more times per week, and even more preferably about 5 mg to about 200 mg per dose one or more times per week. The patient may also receive a biweekly dose of an LRP6 conjugate in the range of about 50 mg to about 800 mg or a monthly dose of an LRP6 conjugate in the range of about 50 mg to about 1,200 mg.

In other embodiments, an LRP6 conjugate may be administered to a patient in a typical dosage range of about 0.5 mg per week to about 2000 mg per week, about 1.0 mg per week to about 1000 mg per week, about 5 mg per week to about 500 mg per week, about 10 mg per week to about 100 mg per week, about 20 mg per week to about 80 mg per week, about 100 mg per week to about 300 mg per week, or about 100 mg per week to about 200 mg per week. In another aspect, the dosages for administration to a 70 kg patient can range from, for example, about 1 μg to about 5000 mg, about 2 μg to about 4500 mg, about 3 μg to about 4000 mg, about 4 μg to about 3,500 mg, about 5 μg to about 3000 mg, about 6 μg to about 2500 mg, about 7 μg to about 2000 mg, about μg to about 1900 mg, about 9 μg to about 1,800 mg, about 10 μg to about 1,700 mg, about 15 μg to about 1,600 mg, about 20 μg to about 1,575 mg, about 30 μg to about 1,550 mg, about 40 μg to about 1,500 mg, about 50 μg to about 1,475 mg, about 100 μg to about 1,450 mg, about 200 μg to about 1,425 mg, about 300 μg to about 1,000 mg, about 400 μg to about 975 mg, about 500 μg to about 650 mg, about 0.5 mg to about 625 mg, about 1 mg to about 600 mg, about 1.25 mg to about 575 mg, about 1.5 mg to about 550 mg, about 2.0 mg to about 525 mg, about 2.5 mg to about 500 mg, about 3.0 mg to about 475 mg, about 3.5 mg to about 450 mg, about 4.0 mg to about 425 mg, about 4.5 mg to about 400 mg, about 5 mg to about 375 mg, about 10 mg to about 350 mg, about 20 mg to about 325 mg, about 30 mg to about 300 mg, about 40 mg to about 275 mg, about 50 mg to about 250 mg, about 100 mg to about 225 mg, about 90 mg to about 200 mg, about 80 mg to about 175 mg, about 70 mg to about 150 mg, or about 60 mg to about 125 mg, of an HSA linker conjugate provided herein. Dosage regimen may be adjusted to provide the optimum therapeutic response. In another aspect, an LRP6 conjugate may be administered in the range of about 0.5 mg every other day to about 500 mg every other day, preferably about 5 mg every other day to about 75 mg every other day, more preferably about 10 mg every other day to about 50 mg every other day, and even more preferably 20 mg every other day to about 40 mg every other day. An LRP6 conjugate may also be administered in the range of about 0.5 mg three times per week to about 100 mg three times per week, preferably about 5 mg three times per week to about 75 mg three times per week, more preferably about 10 mg three times per week to about 50 mg three times per week, and even more preferably about 20 mg three times per week to about 40 mg three times per week.

In non-limiting embodiments of the methods of the present invention, an LRP6 conjugate is administered to a mammal (e.g., a human) continuously for 1, 2, 3, or 4 hours; 1, 2, 3, or 4 times a day; every other day or every third, fourth, fifth, or sixth day; 1, 2, 3, 4, 5, 6, 7, 8, 9, or 10 times a week; biweekly; 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 times a month; bimonthly; 1, 2, 3, 4, 5, 6, 7, 8, 9, or 10 times every six months; 1, 2, 3, 4, 5, 6, 7, 8, 9, 10, 11, 12, 13, 14, 15, 16, 17, 18, 19, or 20 times a year; or biannually. An LRP6 conjugate may be administered at different frequencies during a therapeutic regime. In additional embodiments, an LRP6 conjugate may be administered to a patient at the same frequency or at a different frequency.

The amount of one or more diagnostic or therapeutic agents and an LRP6 conjugate required to achieve the desired therapeutic effect depends on a number of factors, such as the specific diagnostic or therapeutic agent(s) chosen, the mode of administration, and clinical condition of the recipient. A skilled artisan will be able to determine the appropriate dosages of one or more diagnostic or therapeutic agents and an LRP6 conjugate to achieve the desired results.

Single or multiple administrations of the compositions comprising an effective amount of an LRP6 conjugate can be carried out with dose levels and pattern being selected by the treating physician. The dose and administration schedule can be determined and adjusted based on the severity of the disease or condition in a mammal (e.g., a human), which may be monitored throughout the course of treatment according to the methods commonly practiced by clinicians or those described herein.

An LRP6 conjugate can be administered to a mammalian subject, such as a human, directly or in combination with any pharmaceutically acceptable carrier or salt known in the art. Pharmaceutically acceptable salts may include non-toxic acid addition salts or metal complexes that are commonly used in the pharmaceutical industry. Examples of acid addition salts include organic acids such as acetic, lactic, pamoic, maleic, citric, malic, ascorbic, succinic, benzoic, palmitic, suberic, salicylic, tartaric, methanesulfonic, toluenesulfonic, or trifluoroacetic acids or the like; polymeric acids such as tannic acid, carboxymethyl cellulose, or the like; and inorganic acids such as hydrochloric acid, hydrobromic acid, sulfuric acid phosphoric acid, or the like. Metal complexes include zinc, iron, and the like. One exemplary pharmaceutically acceptable carrier is physiological saline. Other physiologically acceptable carriers and their formulations are known to one skilled in the art and described, for example, in Remington's Pharmaceutical Sciences, ($18^{th}$ edition), ed. A. Gennaro, 1990, Mack Publishing Company, Easton, Pa. Diagnostic and Therapeutic Applications LRP6 conjugates can be used for diagnostic and therapeutic applications in a human, including, for example, the diagnosis or treatment of proliferative diseases (e.g., cancers, such as melanoma, clear cell sarcoma, and renal cancer) and autoimmune diseases (e.g., multiple sclerosis, rheumatoid arthritis, and uveitis). The following discussion of human proliferative and autoimmune diseases is meant to provide the skilled practitioner with a general understanding of how LRP6 conjugates can be applied in diagnostic and therapeutic applications and is not meant to limit the scope of the present invention.

The invention having been fully described, it is further illustrated by the following examples and claims, which are illustrative and are not meant to be further limiting.

EXAMPLES

Example 1

Generation of Anti-LRP6 Mono and Biparatopic Serum Albumin Fusions

This example describes the production and characterization of mono-specific and biparatopic anti-LRP6 antibodies designed as fusions of anti-LRP6 Fab to serum albumin for mono-specific formats and as fusions of anti-LRP6 Fab and anti-LRP6 scFv or scFab to serum albumin for biparatopic formats. In addition to fusions with wild type mouse serum albumin (MSA), fusions were also prepared where the free cysteines in MSA or human serum albumin (HSA) were mutated to serines (MSA(C:S) or HSA(C:S)). The mono-specific variants were designed by C-terminal addition of MSA, MSA(C:S) or HSA(C:S) to anti-LRP6 Fab. The biparatopic variants were designed by C-terminal addition of either anti-LRP6 scFv or anti-LRP6 scFab (Fab with 6× $Gly_4Ser$-linker between CL and VH) to anti-LRP6 Fab MSA or anti-LRP6 Fab MSA(C:S)/HSA(C:S) backbone.

(a) Materials and Methods (i) Generation of Mono-Specific Anti-LRP6 Fabs Fused to Serum Albumin Anti-LRP6_MOR08168Fab-MSA MOR08168-VH was amplified from vector pMORPHx9-FH-MOR08168 and the PCR product was cloned via NruI/BlpI into vector pRS5a-MOR06706-MSA (primer 1: gctacgtcgcgattctggaaggcgtgcactgtcaggtgcaattggtggaaagc (SEQ ID NO: 301), primer 2: gctacggctagctgagctaaccgtcaccag (SEQ ID NO:302). The resulting vector was called pRS5a-MOR08168-MSA.

MOR08168-VL was amplified from vector pMORPHx9-FH-MOR08168 and the PCR product was cloned via AgeI/HindIII into vector pRS5a-hlambda-MOR06706 (primer 3: gctacgaccggtgatatcgaactgacccagccg (SEQ ID NO: 303), primer 4: gctacgaagcttcgtgccgccgccaaac (SEQ ID NO: 304). The resulting vector was called pRS5a-hlambda-MOR08168.

Anti-LRP6_MOR08168 Fab-MSA (C:S)

Substitution C58S within the MSA gene was introduced by QuickChange Site-Directed Mutagenesis (Agilent) in vector pRS5a-MSA-MOR08168 (primer 5: cagtacctgcagaagtccagctacgacgagcac (SEQ ID NO: 305), primer 6: gtgctcgtcgtagctggacttctgcaggtactg (SEQ ID NO: 306).

Substitution C6035 within the MSA gene was introduced by PCR followed by cloning of the PCR product via AgeI/AscI into vector pRS5a-MSA-MOR0168_C585 (primer 7: ggcccacaagagcgagatcgccc (SEQ ID NO: 307), primer 8: gcggccgcccggcgcgcctcatcagtgatggtgatgatggtgggccagggcgtccttggaccgggtcaccaggttggg (SEQ ID NO: 308). Finally gene optimized MOR08168-VH was amplified from Geneart vector 0924690_8168scfvCH1mut_cys and cloned via MfeI/BlpI into vector pRS5a-MSA-MOR08168_C58S_C6035, the resulting vector was called pRS5a-MSA-MORO8168opt_C58S_C603S (primer 9: tgtcaggtgcaattggtcgagtctggcggaggactg (SEQ ID NO: 309), primer 10: ccttggtgctggctgagctg (SEQ ID NO: 310). Gene optimized MOR08168-VL was amplified from the Geneart vector 0924690_8168sc-fvCH1mut_cys and cloned via AgeI/HindIII into vector pRS5a-hlambda. The resulting vector was called pRS5a-hlambda-MOR08168opt (primer 11: gcttccggacaccaccggtgacatcgagctgacccagcc (SEQ ID NO: 311), primer 12: cagcacggtaagcttggtgcctccgccgaacaccag (SEQ ID NO: 312).

Anti-LRP6_MOR08168Fab-HSA (C:S)

A DNA fragment coding for HSA-C:S was isolated from vector pRS5aHSAcys and cloned via NheI/AscI into pRS5a-MSA-MOR08168opt_C58S_C603S. The resulting vector was called pRS5a-MOR08168opt_HSA_CtoS. MOR08168-LC (pRS5a-hlambda-MOR08168opt) was generated as described for anti-LRP6_MOR08168 Fab-MSA (C:S).

Anti-LRP6_MOR08545 Fab-MSA

A gene optimized DNA fragment coding for MOR08545-VH was isolated from Geneart vector 0814746_MOR08545_heavy-mamma via NruI/NheI and cloned into vector pRS5a-h-IgG1(MV)-MSA, the resulting vector was called pRS5a-MSA-MOR08545. A gene optimized DNA fragment coding for MOR08545-VL was isolated from Geneart vector 0814747_MOR08545_light_mamma via AgeI/NarI and cloned into vector pRS5a-h-lambda, the resulting vector was called pRS5a-h-lambda-MOR08545.

Anti-LRP6_MOR06707 Fab-MSA

A gene optimized DNA fragment coding for MOR06707-VH was isolated from Geneart vector 0814748_MOR06707_heavy_mamma via NruI/NheI and cloned into pRS5a-MSA-MOR08545, the resulting vector was called pRS5a-MSA-MOR06707. A gene optimized DNA fragment coding for MOR06707-VL was isolated from Geneart vector 0814749_MOR06707_light_mamma via AgeI/NarI and cloned into vector pRS5a-h-lambda, the resulting vector was called pRS5a-h-lambda-MOR06707.

Anti-LRP6_MOR06706 Fab-MSA

MOR06706-VH was amplified from vector pMORPHx9-FH-MOR06706 and the PCR product was cloned via NruI/NheI into vector pRS5a(MV)-hIgG1-MSA-6707-SalI (primer 27: gctacgtcgcgattctggaaggcgtg-cactgtcaggtgcaattggtggaaagc (SEQ ID NO: 313), primer 28: gctacggctagctgagctaaccgtcaccag (SEQ ID NO: 314). The resulting vector was called pRS5a-hIgG1-MOR06706-SalI-MSA. A HindIII site upstream of the start codon in vector pRS5a-hlambda-MOR06707 was removed by QuickChange Site-Directed Mutagenesis (Agilent) (primer 29: ggtccaactg-cacggtagctttctagagccg (SEQ ID NO: 315), primer 30: cggctctagaaagctaccgtgcagttggacc (SEQ ID NO: 316). In a second mutagenesis step a HindIII site was integrated between sequence regions coding for VL and CL in vector pRS5a-hlambda-MOR06707-w/o-HindIII (primer 31: gcg-gaacaaagcttaccgtgctgggcc (SEQ ID NO: 317), primer 32: ggcccagcacggtaagctttgttccgc (SEQ ID NO: 318). MOR06706-VL was amplified from vector pMORPHx9-FH-MOR06706 and the PCR product was cloned via AgeI/HindIII into mutated vector pRS5a-hlambda-MOR06707 (primer 33: gctacgaccggtgatatcgaactgacccagccg (SEQ ID NO: 319), primer 34: gctacgaagcttcgtgccgccgccaaac (SEQ ID NO: 320). The resulting vector was called pRS5a-hlambda-MOR06706.

Anti-LRP6 MOR06475 Fab-MSA

MOR06475 Fab was fused to the N-terminus of MSA using vector pRS5a with the VH leader sequence. There was a hinge linker in between MOR06475 and MSA. The Hinge linker sequence was DKTHT. The resulting vector was called pRS5a-MSA-MOR6475 501. The protein was expressed in 293T suspension cells and purified by KappaSelect.

Anti-LRP6 MOR06475 scFv-MSA

MOR06475 scFv in LH orientation was fused to N-terminal of MSA using vector pRS5a with the VH leader sequence. There was a $(Gly_4Ser)_2$ linker between MOR06475 scFv and MSA. There was a His tag at the C-terminal of MSA for purification purpose. The resulting vector was called pRS5a-scFv6475-MSA 507. The protein was expressed in 293T suspension cells and purified by NTi resin from Qiagen.

(ii) Generation of Biparatopic Anti-LRP6 Constructs Based on Fusion to Serum Albumin Anti-LRP6_MOR08168 Fab-MSA (C:S) MOR06475 scFv BstEII restriction site was introduced in vector pRS5a-MOR08168opt-HSA-C to S by QuickChange Site-Directed Mutagenesis (Agilent), primer 13: ggccagggcacacttgtgaccgt-cagctc (SEQ ID NO: 321), primer 14: gagctgacggtcacaagtgt-gccctggcc (SEQ ID NO: 322). The resulting vector was called pRS5a-MOR08168opt-MSA-C58S-C603S__1BsteII_site. MOR06475 scFv was amplified from vector pRS5a-MOR06475-scFv and the PCR product was cloned into vector pRS5a-MOR08168opt-MSA-C58S-C603S__1BsteII_site via BstEII/XbaI (primer 15: ggccccaacctggtgacccggtccaag-gacgccctggccggcggctccggcggaagcgatatcgtgctgacacagagccc (SEQ ID NO: 323), primer 16: gtttaaacgggccactagagcggc-cgcccggcgcgcctcagaggacactgtcaccagggttc (SEQ ID NO: 324). The resulting vector was called pRS5a-MOR08168opt-MSA-CtoS-6475scFv. MOR08168-LC (pRS5a-hlambda-MOR08168opt) was generated as described for anti-LRP6_MOR08168 Fab-MSA (C:S).

Anti-LRP6_MOR08168 Fab-HSA (C:S) MOR06475 scFv

AfeI restriction site was introduced in vector pRS5a-MOR08168opt-HSA-C58S_C603S by QuickChange Site-Directed Mutagenesis (Agilent), primer 17: gcggccagtcag-gcagcgcttggtttgtgatg (SEQ ID NO: 325), primer 18: catcacaaaccaagcgctgcctgactggccgc (SEQ ID NO: 326). The resulting vector was called pRS5a-MOR08168opt-HSA-CtoS_AfeI. MOR06475-scFv was amplified from vector pRS5a-hIgG1LALA-MOR08168opt-6475scFv and the PCR product was cloned into vector pRS5a-MOR08168opt-HSA-CtoS_AfeI via AfeI/XbaI (primer 19: caggcagcgcttg-gtttgggcggctccggcggaagcgatatcg (SEQ ID NO: 327), primer 20: gggtttaaacgggccctctagagc (SEQ ID NO: 328). The resulting vector was called pRS5a-MOR08168opt-HSA-CtoS-6475-scFv. MOR08168-LC (pRS5a-hlambda-MOR08168opt) was generated as described for anti-LRP6_MOR08168 Fab-MSA (C:S).

Anti-LRP6_MOR08168 Fab-HSA (C:S) MOR06475 scFab

MOR06475 scFab was amplified from vector pRS5a-hkappa-linker-hIgG1LALA-MOR06475 (coding for the full IgG1LALA with a 6× $Gly_4$Ser-linker between CL and VH) and the PCR product was cloned into vector pRS5a-MOR08168opt-HSA-CtoS_AfeI via AfeI/XbaI (primer 21: caggcagcgcttggtttgggcggctccg-gcggaagcgatatcgtgctgacccagagcc (SEQ ID NO: 329), primer 22: gccctctagagcggccgcccggcgcgc-ctcatcagcagctcttgggctccactctcttg (SEQ ID NO: 330). The resulting vector was called pRS5a-MOR08168opt-HSA-CtoS-6475-scFab. MOR08168-LC (pRS5a-hlambda-MOR08168opt) was generated as described for anti-LRP6_MOR08168 Fab-MSA (C:S).

(iii) Transient Expression of Mono-Specific and Biparatopic Anti-LRP6 Fab MSA/MSA(C:S)/HSA(C:S) Fusions 3-4 L HEK293 cells were cultivated in V3 Media: Lot #D07668B in a BioWave20 at Rocks 10 rpm, Angle 7°, Aeration 25 L/h, 25% $O_2$, 6% $CO_2$ to a density of 2E6 viable cells/mL. The cells were transiently transfected with 1-2 L DNA:PEI-MIX in V3 media (plasmid: 5 mg HC+5 mg LC+20 mg PEI). 6 h after transfection 5 L Feeding media (Novartis): Lot #09-021 was added to the culture. The cells were then further cultivated at Rocks 24 rpm, Angle: 7°, Aeration 25 L/h, 25% $O_2$, 0-6% $CO_2$. Seven to ten days after transfection, cells were removed by crossflow filtration using Fresenius filters 0.2 μm. Afterwards the cell free material was concentrated to 1.75 L with cross-flow filtration using a 10 kDa cut off filter from Fresenius. The concentrate was sterile filtered through a stericup filter (0.22 μm). The sterile supernatant was stored at 4° C.

All described anti-LRP6 Fab fusion variants were expressed in a similar manner to that described above.

(iv) Purification of Mono-Specific and Biparatopic Anti-LRP6 Fab MSA/MSA(C:S)/HSA(C:S) Fusions Purification was performed on an ÄKTA 100 explorer Air chromatography system at 4° C. in a cooling cabinet, using a freshly sanitized (0.5 M NaOH/30% isopropanol) XK16/20 column with 10 ml of CaptureSelect Fab lambda affinity matrix (BAC #0849.10). All flow rates were 2 ml/min, except for loading, 1 ml/min. The column was equilibrated with 10 CV of PBS (made from 10×, Gibco), then the concentrated and sterile filtered fermentation supernatant (ca. 1 l) was loaded at 1.0 ml/min. The column was washed with 10 CV of PBS. Then the Fab fusion was eluted with 5 CV of 100 mM Glycine/HCl-Buffer pH 3.0. The eluate was collected in 3 ml fractions in tubes containing 0.3 ml of 1M Tris/HCl pH 9.0. The pools were sterile filtered (Millipore Steriflip, 0.22 μm), the OD 280 nm was measured in a Lambda 35 Spectrometer (Perkin Elmer), and the protein concentration was calculated based on the sequence data. The pools were separately tested for aggregation (SEC-MALS) and purity (SDS-PAGE, LAL and MS), and based on the results, only the central pool was further used. For second purification steps, pools from the first purification were loaded into a freshly sanitized (0.5 M NaOH/30% isopropanol) HiLoad 26/60-Superdex200 column (GE-Healthcare), the run was done with PBS at 1 ml/min, the eluate was collected in 4 ml fractions and analyzed as described for the first purification step.

All described biaparatopic anti-LRP6 Fab fusion variants were purified in a similar manner to that described above.

(v) Size Exclusion Chromatography Coupled with Multi-Angle Light Scattering Detector (SEC-MALS)

SEC-MALS measurements were performed on an Agilent 1200 HPLC system (Agilent Technologies) connected to a tri-angle light scattering detector (miniDAWN Treos, Wyatt Technology, Santa Barbara, Calif., USA). The concentration of the sample was followed online with a differential refractometer (Optilab rEX, Wyatt Technology) using a specific refractive index increment (dn/dc) value of 0.186 ml/g (Wen et al., 1996 Anal Biochem. 240:155-66). Sample volumes of 50 μl were injected on a Superdex 200 10/300 GL column (GE Healthcare). The data were recorded and processed using the ASTRA V software (Wyatt Technology). To determine the detector delay volumes and normalization coefficients for the MALS detector, a BSA sample (Sigma, Catalog #A8531) was used as reference. Neither despiking nor a band broadening correction was applied.

Example 2

Generation of a Biparatopic LRP6 Antibody Half Molecule

This example describes the production and characterization of biparatopic anti-LRP6 IgG1 LALA antibody half-molecules. Antibody half-molecules were engineered using a combination of hinge mutations (cysteines to glycines or serines) to prevent disulfide bond formation and CH3 mutations (F405T and Y407D) to disrupt the non-covalent bonds. Biparatopic variants were designed by C-terminal fusion of anti-LRP6 scFv to anti-LRP6 antibody half-molecule. Variants with an additional CH2 and CH3 (F405T, Y407D) domain were also produced.

(a) Materials and Methods (i) Generation of Biparatopic LRP6 Antibody Half Molecule Anti-LRP6_MOR08168 hIgG1LALA (mut Hinge F:T; Y:D) MOR06475 scFv Both cysteines within the hinge region of MOR08168opt-hIgG1LALA were substituted to glycines by QuickChange Site-Directed Mutagenesis (Agilent) in vector pRS5a-hIgG1LALA-MOR08168opt-6475scFv (primer 23: caagacccacaccggcccccccggcccagccccagaggc (SEQ ID NO: 331), primer 24: gcctctggggctgggccgggggggccggtgtgggtcttg (SEQ ID NO: 332). Furthermore substitutions FtoT and YtoD were introduced in the CH3 domain of vector pRS5a-hIgG1LALA-MOR08168opt-6475scFv_mut_Hinge by QuickChange Site-Directed Mutagenesis (Agilent), primer 25: gcgacggcagcttcaccctggacagcaagctgacc (SEQ ID NO: 333), primer 26: ggtcagcttgctgtccagggtgaagctgccgtcgc (SEQ ID NO: 334). The resulting vector was called pRS5a-hIgG1LALA-MOR08168opt-6475scFv_mut-Hinge_FtoT_YtoD. MOR08168-LC (pRS5a-hlambda-MOR08168opt) was generated as described for anti-LRP6_MOR08168 Fab-MSA (C:S) in the previous example.

Anti-LRP6_MOR08168 hIgG1LALA 2(CH2_CH3) (mut Hinge F:T; Y:D) MOR06475 scFv

A gene optimized DNA fragment coding for the complete CH2/3-domain of hIgG1LALA (mut Hinge F:T; Y:D) was isolated from DNA2.0 vector 49692_CLONED and cloned via AfeI/BamHI into vector pRS5a-hIgG1LALA-MOR08168opt-6475scFv_mut-Hinge_FtoT_YtoD. The resulting vector was called pRS5a-hIgG1LALA-MOR08168opt-2×CH2/3-6475scFv_mut-Hinge_FtoT_YtoD. MOR08168-LC (pRS5a-hlambda-MOR08168opt) was generated as described for anti-LRP6_MOR08168 Fab-MSA (C:S) in the previous example.

(ii) Transient Expression of Biparatopic Anti-LRP6 Antibody Half Molecule

Transient expression was performed as described in example 1 above.

(iii) Purification of Biparatopic Anti-LRP6 Antibody Half Molecules

Anti-LRP6_MOR08168 hIgG1LALA (mut Hinge F:T; Y:D) MOR06475 scFv

The purification of the biparatopic antibody half molecule was performed on an ÄKTA 100 explorer Air chromatography system at 4° C. in a cooling cabinet, using a 5 ml HiTrap Protein G column (GE-Healthcare). All flow rates were 3 ml/min, except for loading, 1 ml/min. The column was equilibrated with 10 CV of PBS (made from 10×, Gibco), then the concentrated and sterile filtered fermentation supernatant (ca. 1 L) was loaded at 1.0 ml/min. The column was washed with 10 CV of PBS. Then the antibody half-molecule was eluted with a gradient from 100 mM Glycine/HCl-Buffer pH 4.5 to 100 mM Glycine/HCl-Buffer pH 2.5 (12 CV) followed by 6 CV of 100 mM Glycine/HCl-Buffer pH 2.0. Fractions (1 ml) corresponding to detected peak were pooled and neutralized by addition of 10% vol. of 1M Tris/HCl pH 9.0. The pools were sterile filtered (Millipore Steriflip, 0.22 μm), the OD 280 nm was measured in a Lambda 35 Spectrometer (Perkin Elmer), and the protein concentration was calculated based on the sequence data. The pools were separately tested for aggregation (SEC-MALS) and purity (SDS-PAGE, LAL and MS), and based on the results, only the central pool was further used.

Anti-LRP6_MOR08168 hIgG1LALA 2(CH2_CH3) (mut Hinge F:T; Y:D) MOR06475 scFv

The purification of the biparatopic antibody half molecule was performed on an ÄKTA 100 explorer Air chromatography system at 4° C. in a cooling cabinet, using a 5 ml HiTrap MabSelect Sure column (GE-Healthcare). All flow rates were 5 ml/min. The column was equilibrated with 5 CV of PBS (made from 10×, Gibco), then the concentrated and sterile filtered fermentation supernatant (ca. 1 l) was loaded at 5.0 ml/min. The column was washed with 5 CV of PBS followed by 5 CV of 50 mM Citrate, 90 mM NaCl pH 5.5. Then the antibody half-molecule was eluted with 5 CV of 50 mM Citrate, 90 mM NaCl pH 3.0 in 4 ml fractions. Fractions corresponding to detected peak were pooled and neutralized by addition of 1M NaOH to pH 6-7. The pools were sterile filtered (Millipore Steriflip, 0.22 μm), the OD 280 nm was measured in a Lambda 35 Spectrometer (Perkin Elmer), and the protein concentration was calculated based on the sequence data. The pools were separately tested for aggregation (SEC-MALS) and purity (SDS-PAGE, LAL and MS), and based on the results, only the central pool was further used.

(iv) Size Exclusion Chromatography Coupled with Multi-Angle Light Scattering Detector (SEC-MALS)

SEC-MALS was performed as in example 1 of this application.

Example 3

Expression, Purification and Characterization of Anti-LRP6 Mono and Biparatopic Serum Albumin Fusions and Biparatopic LRP6 Antibody Half Molecules All serum albumin fused constructs were successfully expressed and purified. The purified products were checked by SDS-PAGE and showed bands corresponding to their expected size. Further verification by mass spectrometry (MS) demonstrated that anti-LRP6 MOR08168 Fab-HSA (C:S) MOR06475-scFv, anti-LRP6 MOR08168 Fab-MSA (C:S) MOR06475-scFv, anti-LRP6 MOR08168 Fab-MSA, anti-LRP6 MOR08168 Fab-HSA (C:S) and anti-LRP6 MOR06706-MSA corresponded to their expected mass (140207, 139611, 113851, 113594 and 113931 Da, respectively) but with a pyroglutamic acid at the N-terminus. The light chain from anti-LRP6 MOR08168 Fab-HSA (C:S) MOR06475-scFab also corresponded to its expected mass (22837 Da) and the heavy chain was verified by tryptic peptide mass fingerprint (MALDI-TOF and MALDI-TOF/TOF). Aggregation, as determined by SEC MALS, was less than 6% for all anti-LRP6 mono and biparatopic serum albumin fusions.

The biparatopic anti-LRP6 IgG1 antibody half-molecules were also well expressed in monomeric form. Bands corresponding to their expected size were detected by SDS-PAGE. Further verification by MS demonstrated that MOR08168-hIgG1LALA (mut Hinge F:T; Y:D) MOR06475-scFv and MOR08168-hIgG1LALA 2(CH2_CH3) (mut Hinge F:T; Y:D) MOR06475-scFv corresponded to their expected mass (98536 and 123301 Da respectively) but with a pyroglutamic acid at the N-terminus and glycosylation. Aggregation, determined by SEC MALS, was less than 6% for both variants.

Mass Spectrometry Analyses:

All molecules generated for this work were analyzed by mass spectrometry to check their integrity and purity. A standard QC method was in applied, which consists of an LC-MS analysis of the intact molecule and by at least one LC-MS analysis following a treatment of the sample, (i) deglycosylation, (ii) reduction, (iii) reduction and deglycosylation, (iv) reduction and carboxyamidomethylation.

In the case of anti-LRP6 MOR08168 Fab-HSA (C:S) MOR06475-scFab, the identity of the heavy chain had to be confirmed by tryptic peptide mapping.

LC-MS Instrumentation:

The liquid chromatography (LC) was performed on a Waters Acquity UPLC system coupled directly to the mass spectrometer. Solvent A: 2% $CH_3CN$ in $H_2O$ 0.1% formic acid, and solvent B: $CH_3CN$ 0.1% formic acid. The intact sample (4 μg) were separated on MassPrep Cartridge (0.4 mL/min, Waters) with the following gradient: in 5 min from 0% B to 90% B. The treated sample (4 μg) were separated on POROS 10 R1 column (150×1 mm, Morey), with a flow rate of 0.1 μL/min with the following gradient: in 0.5 min from 0% B to 22% B, then in 10 min to 44% B, then in 1 min to 90% B, stay at 90% B for 2 min then back to 0% B.

The electrospray ionization time-of-flight (ESI_TOF) mass spectrometer (Waters Q_TOF Premier Mass Spectrometer) was operated in the positive V-mode, under a source temperature of 120° C., a desolvation temperature of 250° C., a sample cone set at 40 V, and 0.95 Hz scan rate with 0.05 s interscan delay was used to acquire data over the entire analysis. For intact and treated sample measurement, the capillary voltage was set to 1.5 kV and 2.8 kV, and mass spectra were acquired in the m/z range of 1000 to 6000 and 600 to 2000, respectively. Evaluation was performed after deconvolution of the ESI-TOF spectra.

Sample Treatment:

(i) Deglycosylation:

25 μg of lyophilized human IgG are dissolved in 5 μL of 8M urea containing 0.4 M $NH_4HCO_3$. Then 37 μL of 50 mM $NH_4HCO_3$ is added (pH 8.3), followed by 5 μL of reaction buffer G7 and by 1.6 μL of PNGaseF (New England Biolabs, Ipswich, Mass.) and the mixture is incubated at 37° C. for 70 min.

(ii) Reduction:

25 μg of lyophilized human IgG are reduced (for 30 min at 50° C. under nitrogen) with 1.2 μL 1 M DTT after dissolution in 5 μL of 8 M urea/0.4 M $NH_4HCO_3$ (pH 8.3) followed by the addition of 5 μL of 50 mM $NH_4HCO_3$ (pH 8.3).

(iii) Reduction/Deglycosylation

25 μg of lyophilized human IgG are reduced with 1.2 μL 1 M DTT after dissolution in 5 μL of 8 M urea/0.4 M $NH_4HCO_3$ and 5 μL of 50 mM $NH_4HCO_3$ (pH 8.3). After 30 min incubation at 50° C., 5 μL of reaction buffer G7 and 32 μL of 50 mM $NH_4HCO_3$ (pH 8.3) are added followed by 1.6 μL of PNGaseF (New England Biolabs, Ipswich, Mass.) and the mixture is incubated at 37° C. for 70 min.

(iii) Reduction/Carboxyamidomethylation

100 μg of lyophilized human IgG are dissolved in 80 μL of 8M urea/g 0.4 M $NH_4HCO_3$ (pH 8.3), then after addition of 2.3 μL 1 M DTT, the mixture is put under nitrogen and incubated at 50° C. for 30 min. The solution is then cooled down to room temperature, 6.5 μL of 1 M iodoacetamide is added and the mixture is incubated for 30 min at room temperature in the dark. The reaction is stopped by an addition of 10% formic acid to reach pH 3-4.

MALDI-MSMS Analysis:

The carboxyamidomethylated sample (iv) was injected on HPLC for desalting and collecting of each chain. About 4.4 μg of HC was collected and dried on SpeedVac. After dissolution of the c carboxyamidomethylated HC (5 μl 8 M urea 0.4 M $NH_4HCO_3$+40 μl 0.4 M $NH_4HCO_3$+1 μl 1 M Tris pH 10), 1 μl of trypsin (1 μg/μl, Promega) was added and left for incubation overnight at 37° C. The reaction was stopped by an addition of 10% formic acid to reach pH 3-4.

An aliquot of obtained digest (2 μL) was purified by ZipTipC18 (Waters) and directly eluted onto the MALDI target with 2 μl matrix HCCA in acetonitrile/0.1% TFA H2O (50/50). MALDI-TOF MS and MSMS (Autoflex III, Bruker) spectra were acquired in positive reflectron and LIFT mode, respectively. Data evaluation was performed by MASCOT searching against an in-house sequence database.

Example 4

Assessment of In vitro Activity of Anti-LRP6 Mono and Biparatopic Serum Albumin Fusions and Biparatopic LRP6 Antibody Half Molecules in Wnt Reporter Gene Assays The ability of the anti-LRP6 mono and biparatopic serum albumin fusions and biparatopic LRP6 antibody half molecules to inhibit Wnt signaling was tested in a Wnt1 and Wnt3a responsive luciferase reporter gene assay. Cells were either stimulated with Wnt3a conditioned medium, by co-transfection of Wnt 1 or Wnt3a expression plasmids or by co-culture with Wnt1 or Wnt3a overexpressing cells as described below.

(i) Wnt3a Reporter Gene Assay with Conditioned Medium $3\times10^4$ HEK293-STF cells/well were seeded into a 96 well tissue culture plate, and cells were incubated overnight at 37° C./5% $CO_2$ in 100 μL medium.

The following day, various anti-LRP6 construct dilutions were prepared in PBS as 20× solutions. 20 μL/well of the supernatant was removed from the 96 well tissue culture plate and replaced by 5 μL/well of the anti-LRP6 construct dilutions and 15 μL of conditioned medium.

After incubation for 16 to 24 h at 37° C./5% $CO_2$, 100 μL BrightGlo Luciferase reagent (Promega) were added and plates were incubated for 10 min Luminescence was determined using either a Perkin Elmer Envision or Molecular Devices Spectramax M3/M5 plate reader.

(ii) Wnt1/Wnt3a Reporter Gene Assay with Transiently Transfected Cells $3\times10^4$ HEK293T/17 cells/well were seeded into a 96 well tissue culture plate (Costar #3903), and cells were incubated at 37° C./5% $CO_2$ in 100 μL medium. After 12 to 16 h, cells were transfected with Wnt expression plasmid, 1 ng/well; pTA-Luc-10×STF (Firefly luciferase construct) 50 ng/well; and phRL-SV40 (*Renilla* luciferase construct) 0.5 ng/well.

A transfection premix (10 μL/well) was prepared containing the plasmids listed above and 0.2 μL FuGene6/well (Roche). The transfection premix was incubated 15 min at RT and then distributed into the wells. The plate was rocked at 400 rpm for 2 min at RT and then incubated for 4 h at 37° C./5% $CO_2$. After 4 hr transfection incubation, antibodies were diluted in medium to 20× solutions, and added to the transfected cells (5 μL/well).

After 24 h, 75 μL/well DualGlo Luciferase reagent (Promega) were added and the plate was rocked for 10 min for cell lysis before readout of the Firefly luciferase activity as described above. After luminescence readout, 75 μL/well DualGlo Stop&Glow reagent (Promega) were added and luminescence was measured again to determine *Renilla* luciferase activity. For analysis, the ratio between Firefly luciferase activity and *Renilla* luciferase activity was calculated. For $IC_{50}$-determination of the anti-LRP6 constructs, the relative luciferase values were analyzed using GraphPad Prism.

(iii) Wnt1/Wnt3a Co-Culture Reporter Gene Assay

A similar assay can also be performed using co-culture of Wnt1 or other Wnt ligand over-expressing cells (e.g. CHO-K1 or L-cells) with stable STF reporter cell lines (HEK293, NIH/3T3, TM3, PA1, MDA-MB435, MDA-MB231). Briefly, $4\times10^4$ STF reporter cells are plate in 30 μl per well of 96 well TC plate (Costar #3903). $2\times10^4$ stable Wnt ligand expressing cells are added at 30 μl per well. Finally, 30 μl of 3× antibody dilution are added per well. Plate are incubated 37° C./5% $CO_2$ for 40-48 h, and luciferase signal is determined by the addition of 90 μl BrightGlo luciferase reagent (Promega) per well, incubation at room temperature with mild shaking for 10 min and measurement of luminescent signal with a suitable plate reader (e.g. Molecular Devices SpectramaxM3 or M5). Percent activity is measured as a ratio to no antibody control (100% Wnt induction).

Results

The activity of the monovalent serum albumin fusion molecules, anti-LRP6 MOR08168 Fab-MSA, anti-LRP6 MOR08168 Fab-HSA (C:S), anti-LRP6 MOR08545 Fab-MSA, anti-LRP6 MOR06706 Fab-MSA, anti-LRP6 MOR06475 Fab-MSA and anti-LRP6 MOR06475 scFv-MSA is shown in FIG. 1. The MOR08168, MOR08545 and MOR06706 derived molecules were potent inhibitors of Wnt1 but not Wnt3a-stimulated reporter gene activity whereas the MOR06475 derived MSA-fusion constructs were potent inhibitors of Wnt3a but not Wnt1-driven signaling.

The activity of the anti-LRP6 biparatopic serum albumin fusions and biparatopic LRP6 antibody half molecules is summarized in FIG. 2. The data show that the constructs were able to inhibit both Wnt1 and Wnt3a driven signaling.

Example 5

Evaluation of Pharmacokinetic and Pharmacodynamic Properties of Anti-LRP6 Serum Albumin Constructs in vivo The pharmacokinetic (PK) and pharmacodynamic (PD) properties of several of the anti-LRP6 Fab and serum albumin constructs were further characterized in vivo in non-tumor bearing mice and also in an art recognized genetically engineered mouse model known as MMTV-Wnt1. Mammary tumors derived from MMTV-Wnt1 transgenic mice are Wnt1 dependent: for example, turning off Wnt1 expression using a tetracyclin-regulated system (Gunther et al., (2003), Genes Dev. 17, 488-501) or blocking Wnt activity using Fz8CRDFc (DeAlmeida et al., (2007) Cancer Research 67, 5371-5379) inhibits tumor growth in vivo.

Figure 3:
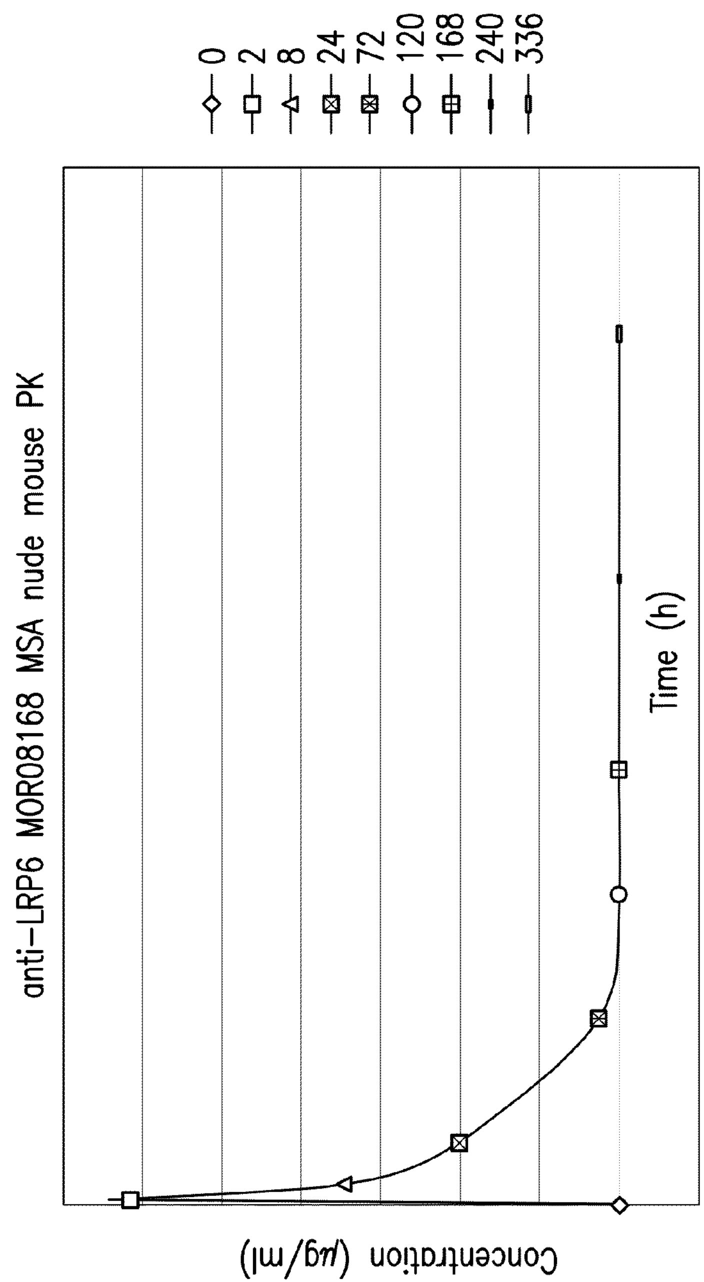
FIG. 3 is a graph showing a single IV dose of an LRP6 mouse serum albumin fusion molecule that binds to β-propeller 1 region at 5 mg/kg in a non-tumor bearing nude mouse.

To determine the PK properties of anti-LRP6 MOR08168 Fab-MSA in non-tumor bearing mice, nude mice were dosed IV with a single dose of 5 mg/kg of anti-LRP6 MOR08168 Fab-MSA. Serum concentrations of the MSA construct were determined by mass spectrometry at multiple time points after completion of the infusion (2, 8, 24, 72, 120, 168, 240 and 336 h, respectively) and results are shown in FIG. 3. The use of mass spectrometry to determine antibody and antibody-like variants serum concentrations is based upon the details described in US2007/088258, incorporated herein by reference. Samples were pH adjusted to 3.5±0.25 by adding hydrochloric acid to a final concentration of 67 mM. Pepsin was subsequently added to a final concentration of 2 μg pepsin/μL serum and the plate was capped, centrifuged briefly, and vortexed. Digestion proceeded for two hours at 37° C. in an oven.

Upon completion of pepsin digestion, samples were diluted 5× with 2M urea/1% sodium deoxycholate (DOC)/10 mM DTT/50 mM ammonium bicarbonate (pH 7.8) and the plate was vortexed. The plate was incubated at 58° C. for two hours in an oven to facilitate disulfide bond reduction by DTT. IAA was added to a final concentration of 20 mM and the plate incubated at ambient temperature in the dark for 1 h to carboxamidomethylate free cysteine residues. 0.75 μg porcine/O_, serum was added. The plate was capped, briefly centrifuged, and vortexed. Samples were digested overnight at 37° C. in an oven. Formic acid was added the following day to a final concentration of 1% (v/v) to terminate the digestion.

Digests were cleaned-up by solid phase extraction (SPE) using Oasis MCX 96-well 30 μm, 30 mg plates (Waters Corp.) in a vacuum manifold. The manufacturer's recommended protocol was followed with minor modifications. Briefly, Oasis MCX wells were prewashed with 1.0 mL methanol followed by 1.0 mL HPLC grade water. Samples were loaded and then washed with 2×1 mL 1% acetic acid followed by 2×1 mL methanol. Subsequently, 1 mL 5% ammonium hydroxide in 50% methanol, 45% ethanol was used to elute into 96-well 2 mL collection plates. Samples were evaporated to dryness and stored at ≤−50° C. Prior to HPLC-MS/MS analysis, the digests were freshly reconstituted in 1% trifluoracetic acid.

2.5 μL serum equivalent was injected onto an Agilent 1100 capillary HPLC. MS/MS analysis was performed on a Quantum Vantage (Thermo-Fisher) operating in SRM mode. Concentration values were determined by comparing peak area ratios of a single peptide representative of the anti-LRP6 molecule normalized to an internal standard peptide to a standard curve generated by serially diluting anti-LRP6 molecule into the corresponding matrix.

Figure 4:
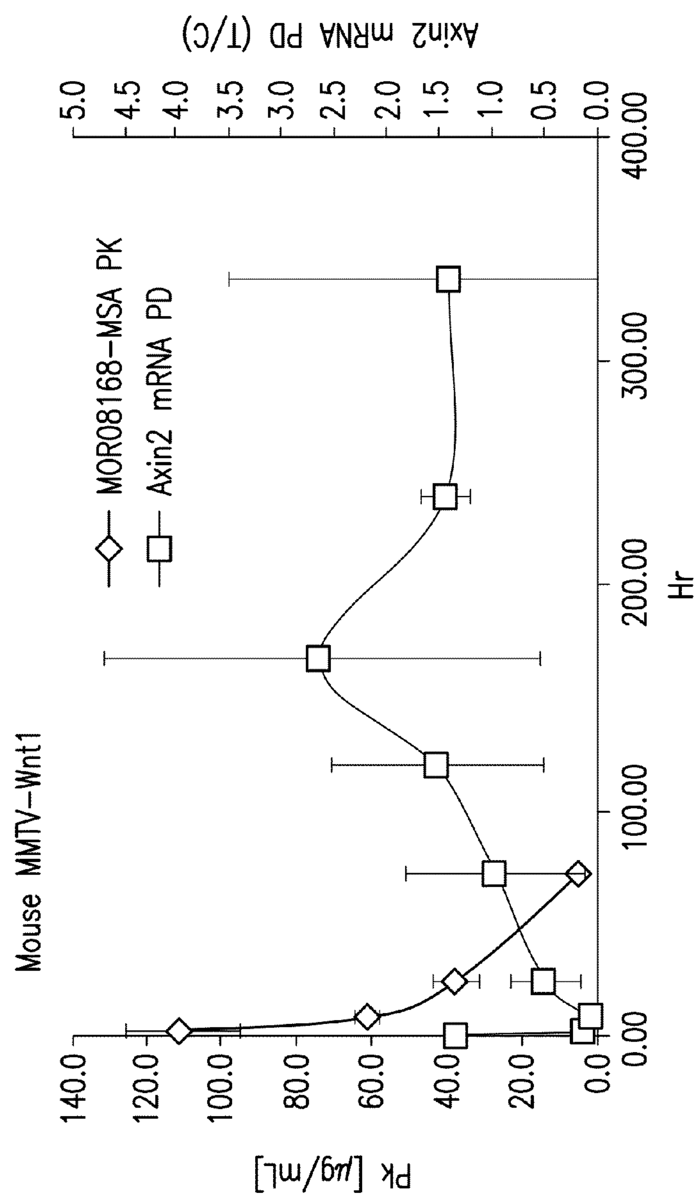
FIG. 4 is a graph showing the serum concentration and effect on Axin2 mRNA of an LRP6 mouse serum albumin fusion molecule that binds to β-propeller 1 region at 5 mg/kg in MMTV-Wnt1 tumor bearing mice.

The effect of anti-LRP6 MOR08168 Fab-MSA on Wnt-signaling in MMTV-Wnt1 tumors was also evaluated. In these studies, MMTV-Wnt1 tumors were dosed intravenously (IV) with a single dose of 5 mg/kg of anti-LRP6 MOR08168 Fab-MSA and serum concentrations of the antibody as well as the mRNA expression of the β-catenin target gene Axin2 were analyzed over a period of 14 days. The results are shown in FIG. 4. The terminal half-life of anti-LRP6 MOR08168 Fab-MSA was around 17 h. In addition, a significant decrease in Axin2 mRNA expression was observed in the tumors that recovered as the level of anti-LRP6 MOR08168 Fab-MSA in serum decreased. Similar studies were performed with anti-LRP6 MOR06706-MSA and anti-LRP6 MOR06706 Fab. Consistent with the data obtained with anti-LRP6 MOR08168 Fab and MSA-fusion, the terminal half-life of the MOR06706 Fab was around 2.7 h. In contrast, the half life of the companion MSA-fusion was around 17 h. In addition, similar to anti-LRP6 MOR08168

Figure 5:
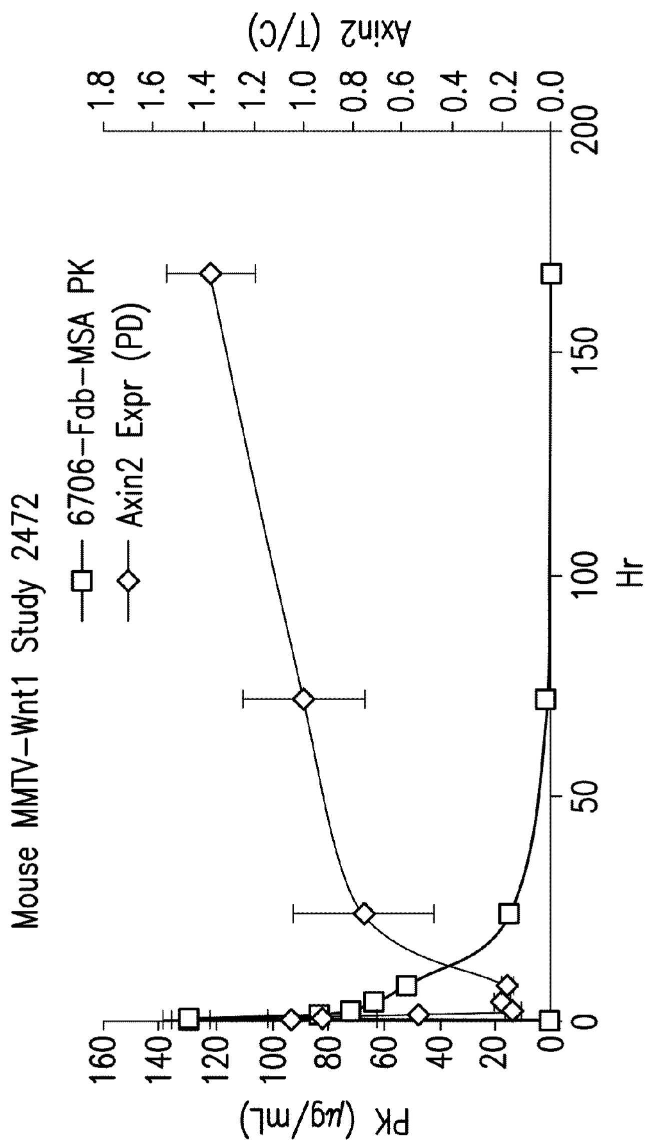
FIG. 5 is a graph showing the serum concentration and effect on Axin2 mRNA of an LRP6 mouse serum albumin fusion molecule that binds to β-propeller 1 region at 5 mg/kg in MMTV-Wnt1 tumor bearing mice.

Fab-MSA, time and concentration dependent changes in Axin2 mRNA were observed following administration of anti-LRP6 MOR06706 Fab-MSA (FIG. 5).

Taken together, these results suggest the fusion to MSA can increase the serum half-life of anti-LRP6 Fab molecules. The data further demonstrate that Wnt1-class specific serum albumin constructs can suppress Wnt signalling in MMTV-Wnt1 xenografts and that this suppression is correlated with serum concentration.

Example 6

Figure 6:
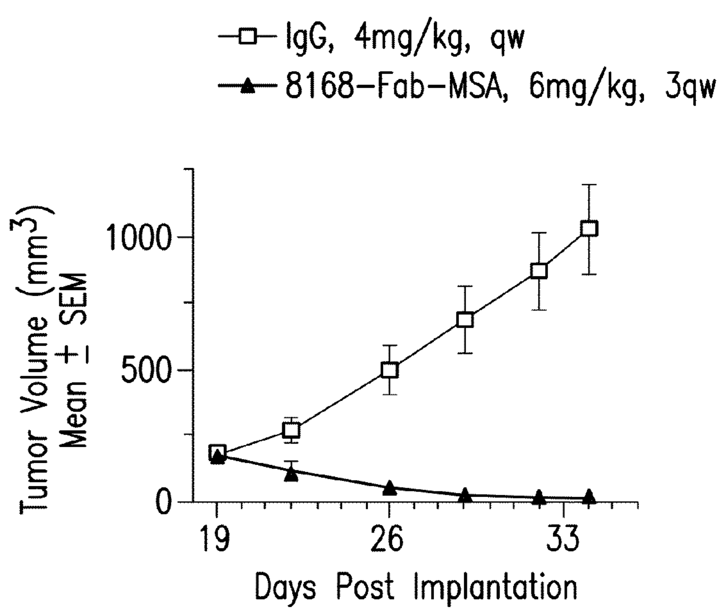
FIG. 6 is a graph showing that a Propeller 1 anti-LRP6 Fab MSA fusion protein causes in vivo tumor regression in a MMTV-Wnt1 model.

Evaluation of in vivo Anti-Tumor Efficacy of Anti-LRP6 Serum Albumin Constructs in MMTV-Wnt1 Allograft Model In addition to the PK-PD studies, the efficacy of the anti-LRP6 serum albumin constructs was also determined in the MMTV-Wnt1 model described in example 5 above. In these studies, MMTV-Wnt1 tumor fragments were implanted subcutaneously (SC) into female nude mice. 19 days after implantation, mice carrying MMTV-Wnt1 tumors (n=8, average 179 $mm^3$; range: 92-380 $mm^3$) were treated with vehicle IgG (4 mg/kg, IV, weekly (qw) or LRP6-Propeller 1 8168-Fab-MSA (6 mg/kg, IV, three times a week (3 qw) and tumors callipered twice per week. LRP6-Propeller 1 8168-Fab-MSA demonstrated antitumor activity (90% regression, $p<0.05$) and results are shown in FIG. 6.

Example 7

PEGylation of 8545 Methodology and in vitro Characterization (i) Generation of an Anti-LRP6_MOR08545 Fab Construct Mutagenesis was performed on pMORPHx9-FH-MOR08545 with primer pairs (primer 35: ccgttgcgccgactgaggcctgctgataagcatgcgtagg (SEQ ID NO: 335), primer 36: cctacgcatgcttatcagcaggcctcagtcggcgcaacgg (SEQ ID NO: 336) in order to generate pMORPHx9-FH-MOR08545-2cys. Then MOR08545-VH and VL were amplified from vector pMORPHx9-FH-MOR08545-2cys with primers pairs (primer 38: cactggctggtttcgctaccg (SEQ ID NO: 337); Primer 39: cgggtggctccaatggtgatggtgatggtggaattcttatcagcagcttttcggttccactffittatc (SEQ ID NO: 338) and the PCR product was digested with EcoRI/XbaI restriction enzymes and ligated into vector pFAB-ExpCol digested with the same enzymes. The resulting construct was termed pFAB-ExpCol/MOR08545-2Cys.

(ii) Microbial Expression of Anti-LRP6 MOR08545 Fab

Plasmid pFAB-ExpCol/MOR08545-2Cys was transformed into *E. coli* BL21 (DE3) cells. Transformed *E. coli* cells were cultivated in a 100 L bioreactor filled with 2×YT medium+0.1% glucose at 220 rpm, 30° C., pH 7.0±0.1. At an $OD_{550}$ of 0.8 the cells were induced with IPTG and harvested by centrifugation after cultivation for an additional 8 h. 100 g wet cell pellet potions were resuspended in 800 mL of Lysis-Buffer (100 mM TrisHCl, 10 mM EDTA, pH 7.5) and lysis was performed for 16 h at 55° C., 400 rpm. After adding 600 U Benzonase and 5 mL $MgCl_2 \times 6H_2O$ (1 M) and stirring for another 1 h at room temperature the periplasmic extracts were harvested by centrifugation (1 h, 11000 g, 4° C.), pooled and cleared extracts were concentrated to 2 L by crossflow filtration using a 10 kDa cut off filter from Fresenius.

(iii) Purification of Anti-LRP6 MOR08545 Fab

Purification was performed on an ÄKTA-3D chromatography system at 4° C. in a cooling cabinet, using a freshly sanitized XK26/20 Protein A Sepharose FF column. All flow rates were 2 ml/min, except for loading, 1 ml/min. The column was equilibrated with 10 CV of PBS, and the concentrated and sterile filtered periplasmic extract (ca. 2 L) was loaded at 1.0 ml/min. The column was washed 2-times, once with 10 CV of PBS containing 0.5 M Arginine and once with 10 CV of PBS only.

Then the Fab was eluted with 5 CV of 50 mM Citrate pH 3.0, 140 mM NaCl. The eluate was collected and immediately neutralized to pH 7.0 with 1 M Tris pH 9.0-10. The pools were sterile filtered (Millipore Steriflip, 0.22 μm), the OD 280 nm was measured with a NanoDrop spectrophotometer, and the protein concentration was calculated based on the sequence data. The pools were tested for aggregation (SEC-MALS), purity (SDS-PAGE, and MS), and low endotoxin (LAL-test). Based on these results, only the central pool was further used.

(iv) Pegylation of Anti-LRP6 MOR08545 Fab

Buffer exchange to 100 mM K-phosphate, 2 mM EDTA, pH 7.5 was performed on a Zeba column. For reduction of the interchain disulfide the Fab was treated with 40 mM TCEP followed by moderate shaking at room temperature for 30 min. TCEP removal was repeated using a Zeba column and the same conditions described above. For PEGylation, a 20-fold molar excess of SUNBRIGHT-ME-200MA (NOF Corporation Japan) was added to the reduced Fab followed by overnight shaking at room temperature. Sample were mixed with 40 mM $CH_3COOH$ at a ratio of 1:4. Pegylation adducts were separated on a TSK-gel SP-5PW cation exchange using a step gradient of buffer A (25 mM $CH_3COOH$, pH 4.5) and buffer B (75 mM $CH_3COOH$, 150 mM NaCl, pH 8.0) and the Fab fraction with two 20 kd PEGs attached to the interchain cysteines were further tested.

(v) Activity of Anti-LRP6 MOR08545 Fab-2×PEG20

Figure 7A:
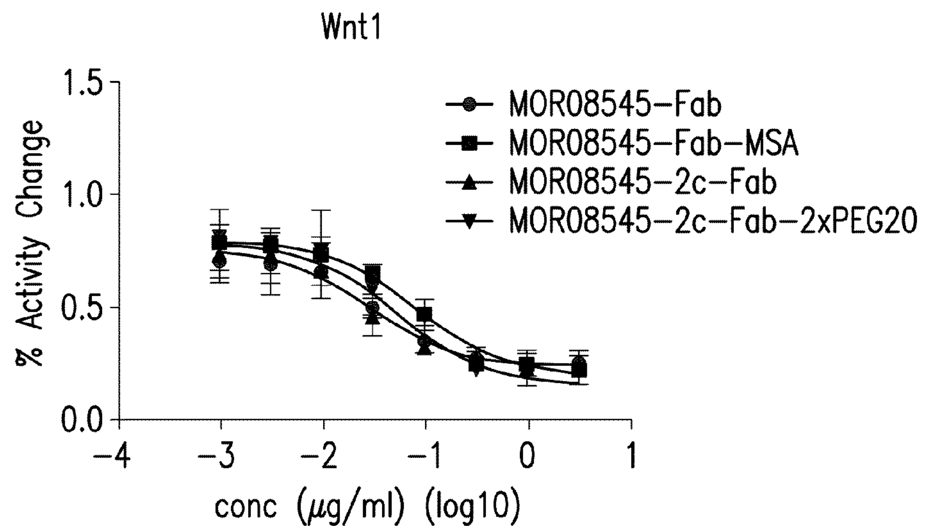
FIGS. 7A-B are graphs showing the activity of anti-LRP6 Fab, mouse serum albumin conjugated and PEGylated anti-LRP molecules in HEK293 STF cells (gene reporter assay) transiently expressing Wnt1 or Wnt3a ligands.
Figure 7B:
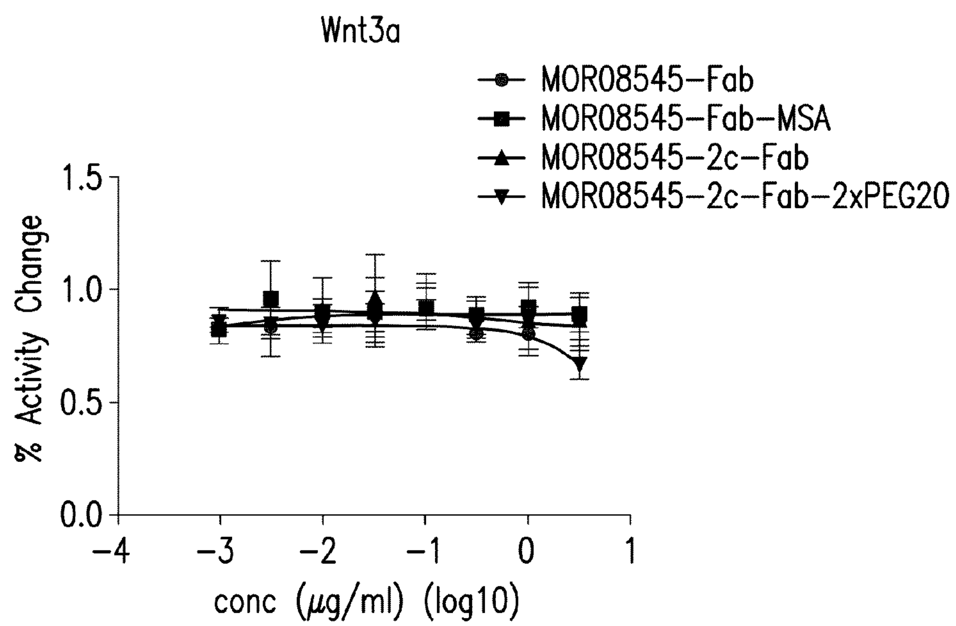

The in vitro activity of anti-LRP6 MOR08545 2c-Fab-2×PEG20 was evaluated using the Wnt1 and Wnt3a-stimulated reporter gene assays as described in example 4. When compared to parental MOR08545 Fab, MOR08545 Fab-MSA (see example 4, FIG. 1) and MOR08545-2c-Fab, anti-LRP6 MOR08545 2c-Fab-2×PEG20 was of similar potency in both the Wnt1 and Wnt3a-stimulated assays (FIG. 7), suggesting that the addition of PEG moieties does not significantly alter the ability of MOR08545 to inhibit Wnt signaling.

The in vitro activity of anti-LRP6 MOR08545 2c-Fab-2×PEG20 was evaluated using the Wnt1 and Wnt3a-stimulated reporter gene assays as described in example 4. When compared to parental MOR08545 Fab, MOR08545 Fab-MSA (see example 4, FIG. 1) and MOR08545-2c-Fab, anti-LRP6 MOR08545 2c-Fab-2×PEG20 was of similar potency in both the Wnt1 and Wnt3a-stimulated assays (FIG. 7), suggesting that the addition of PEG moieties does not significantly alter the ability of MOR08545 to inhibit Wnt signaling.

Example 8

Generation of Bispecific HSA Fusion Proteins

Materials and Methods

Constructs scFv6475 $V_H$ and $V_L$ sequences were from anti-LRP6 MOR08168 IgG1LALA MOR06475 scFv (SEQ ID NO: 166). scFv6475 in $V_L$-$(Gly_4Ser)_4$-$V_H$ orientation was cloned into pNAT43 vector with various leader sequences to enable testing of their effect on expression. Similarly, scFv8168 $V_H$ and $V_L$ sequences were from anti-LRP6 MOR08168hIgG1LALA6475 scFv. scFv8168 in $V_H$-$(Gly_4Ser)_4$-$V_L$ orientation was cloned into pNAT43 vector with pelB leader sequence. A TEV cutting site and a His tag were added to the C-terminal for purification.

Figure 8:
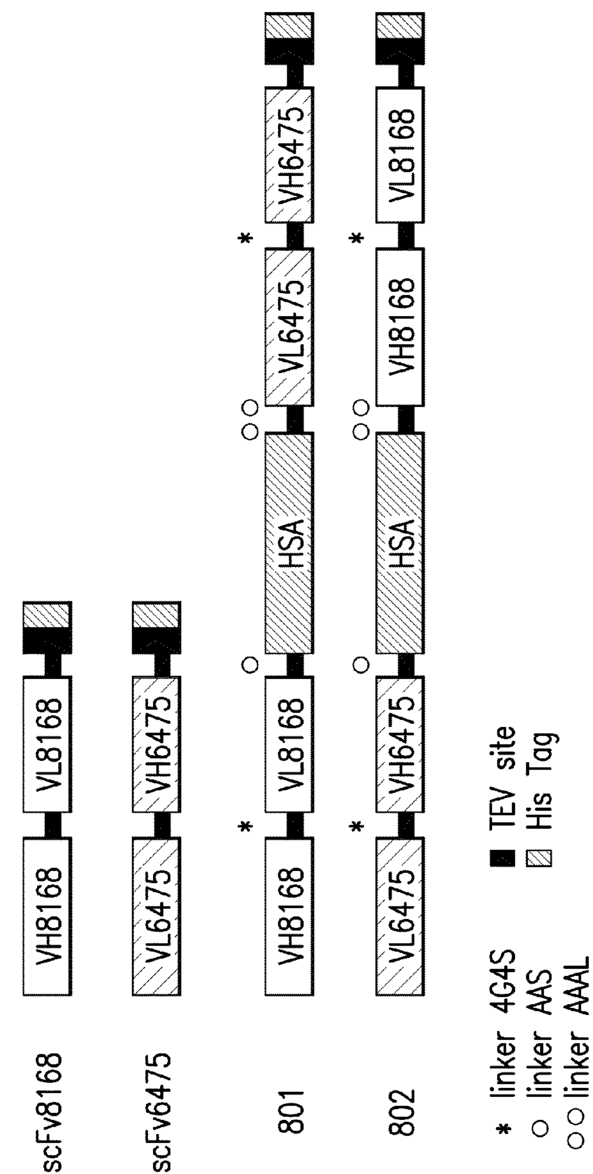
FIG. 8 is a schematic of anti-LRP6 scFvs and HSA fusion molecules.

For HSA fusion biparatopic constructs, scFv8168 was fused to the N-terminus of human serum albumin (HSA; SEQ ID NO: 210) while scFv6475 was fused to the C-terminus of HSA to create the fusion construct 801 (SEQ ID NO: 265), as shown in FIG. 8. The linker between scFv8168 and HSA is AAS, while the linker between HSA and 6475 is AAAL. Two point mutations C34S and N503Q were introduced into HSA to minimize the risk for oxidation and deamination, respectively. In addition, scFv8168 and scFv6475 were fused to HSA in the opposite orientation to create 802 (SEQ ID NO: 269), as shown in FIGS. 8 and 9. Two beneficial mutations for scFv8168 (VH: S34M and S49A) and one mutation for scFv6475 (VH: M100F) were introduced to make the stable version 801T (T for triple mutation) and 802T (T for triple mutation). These mutations were previously described in International Serial No. PCT/EP2011/057200, filed May 6, 2011; and PCT/EP2011/057202, filed May 6, 2011, the contents of which are incorporated herein by reference in their entirety)

Other HSA fusion biparatopic constructs were built according to FIG. 9, with the corresponding linkers and tags or lack thereof. To determine the optimal format, multiple linkers were tested: GS linker (803T (SEQ ID NO: 273) and 804T (SEQ ID NO: 275)), KTHT from upper hinge of human IgG1 (808T, SEQ ID NO: 283), no linker (802T (SEQ ID: 281), 801TF (SEQ ID NO: 293) and 802TF (SEQ ID NO: 295)). In addition, molecules in which optimized scFv8168 and scFv6475 were linked in tandem (812T, SEQ ID NO: 285) and in which HSA was positioned at C-terminal (812T-HSA; SEQ ID NO: 287) were constructed and evaluated. Single module mutant 8168scFv-HSA (809T; SEQ ID NO: 289) and mutant 6475scFv-HSA (810T; SEQ ID NO: 291) molecules were also generated.

Protein Production in Mammalian Cells and Purification with Ni-NTA

Constructs were transiently expressed in 50 ml of 293T suspension cells. Briefly, PEI was mixed with DNA 50 μg at 1:3 for optimal transfection efficiency. Cells at 1.4 e6 per ml were use for transfection. Transfected cells were collected after six days of incubation in $CO_2$ chamber 80 rpm shaking in filter paper flask of 250 ml. Supernatant was concentrated to around 1 ml for optimal protein recovery. Protein is purified manually by MagneHis kit according to the instructions from the manufacturer. Purified protein was dialyzed in PBS overnight with changing of buffers. Protein samples either before or after dialysis were used for DSF analysis.

Purification of Non Tagged HSA Fusion Molecules 293T cells transfected as described above were spun down at 1500 g for 30 minutes. Supernatant was filtered though a 0.8/0.2 μm Pall filter top unit and diluted 1:4 in 50 mM HEPES buffer (pH 7.5). GE Q Sepharose Fast Flow beads were washed in 50 mM HEPES buffer, HEPES/1 M NaCl buffer, and then HEPES buffer before use. 10 ml of beads were added to the diluted supernatant. The mixture was incubated at 4° C. for 2 h with rotation. The binding solution was transferred to a Bio-Rad 2.5×10 cm glass column with extender, and washed with 25 ml of 50 mM HEPES buffer. The protein was eluted in 10 ml fractions using elution buffer (1 M NaCl, 50 mM HEPES). Elution fractions were concentrated to 25 mg/ml using a GE Vivaspin 20 PES 5 kDa MWCO column, and then were loaded onto a HiLoad Superdex 200 26/60 SEC column using a 10 ml injection loop. The column was run at 4 ml/min at 4° C. with Gibco Dulbecco's phosphate buffered saline as the mobile phase. 5 ml fractions were collected and pooled based on purity.

Evaluation of Constructs by Differential Scanning Calorimetry (DSC)

After expression in mammalian 293T cells and purification as described above, 400 μl of the following samples were injected into MicroCal VP-Capillary DSC system for the characterization of their thermal stability: 801 at 13.88 μM, 801T at 9.34 μM, 802 at 15.04 μM, and 802T at 9.75 μM. The DSC profiles were then analyzed in Origin with the DSC analysis program provided by MicroCal.

Results and Discussion

Building and Optimization of HSA Fusion Molecules

Figure 10A:
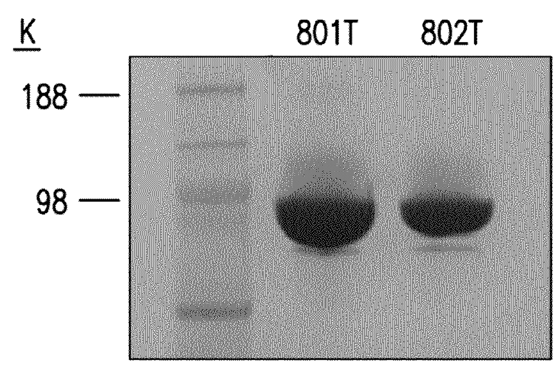
FIGS. 10A-C are photographs of SDS-PAGE gels showing purified bispecific HSA fusion molecules.
Figure 10B:
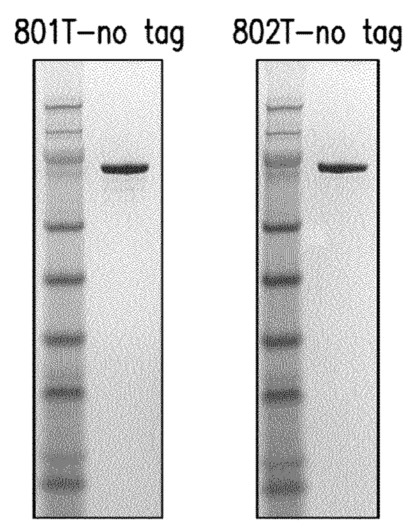
Figure 10C:
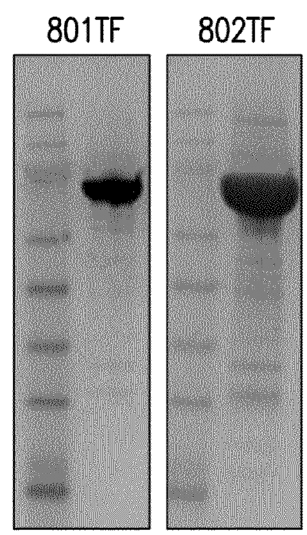

Using stability improved scFv8168 and scFc6475, a number of HSA fusion constructs were designed and constructed for the optimization of binding activity, as well as stability. There were two mutations in scFv8168 (VH: S34M and S49A) and one mutation in scFv6475 (VH: M100F), therefore these fusion molecules were termed T for triple mutations. As shown in FIG. 10, there were three modules in the constructs. In 801T and 803T, scFv8168 (VH: S34M and S49A) as module 1 was placed at the N-terminus of HSA (module 2) while scFv6475 (VH: M100F) as module 3 was located at the C-terminus of HSA. For 802T and 808T, scFv 6475 (VH: M100F) was placed at the N-terminus of HSA while scFv8168 (VH: S34M and S49A) was located at the C-terminus of HSA. scFv6475 (VH: M100F) and scFv8168 (VH: S34M and S49A) were fused in tandem in 812T, or followed by HSA in 812T-HSA.

The linker between module 1 and module 2 is referred to as linker 1 and linker 2 refers to the linker between module 2 and module 3. In 801T and 802T, linker 1 is AAS, linker 2 is AAAL. In 803T and 804T, linker 1 is $Gly_4SerGlySer$ and linker 2 is 3× $Gly_4Ser$. In 808T the hinge linker KTHT was used for both linkers. There were no linkers in 801TF and 802TF and 802T no linker. 809 comprised scFv8168 and HSA connected via a 4× $Gly_4Ser$ linker. Similarly, 810 comprised scFv6475 and HSA connected via a 4× $Gly_4Ser$ linker.

Expression and Non-Tag Purification of HSA Fusion Molecules

The expression of both His-tagged HSA fusion as well as non-tagged fusion molecules was in the range of 100-200 mg/L. Different linker modifications did not appear to affect the expression in mammalian cells (data not shown). The purification of non-tagged HSA fusion molecules was robust, yielding around 70-80 mg of purified protein per liter, as shown in FIG. 10. The mass of the molecules were checked by LC-MS and the molecular weight was consistent with those predicted (data not shown).

Thermostability and Aggregation Profile of HSA Molecules

Figure 12A:
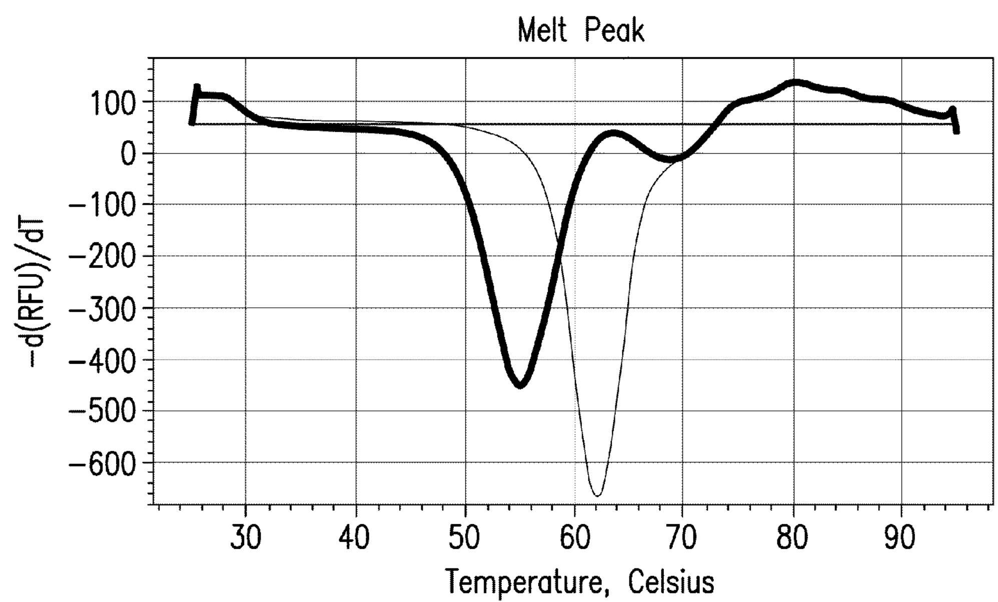
FIGS. 12A and B are graphs from DSF experiments showing the Tm of each molecule. The Tm is indicated by the midpoint of the peak or peaks. The curves from non mutated molecules are highlighted.
Figure 12B:
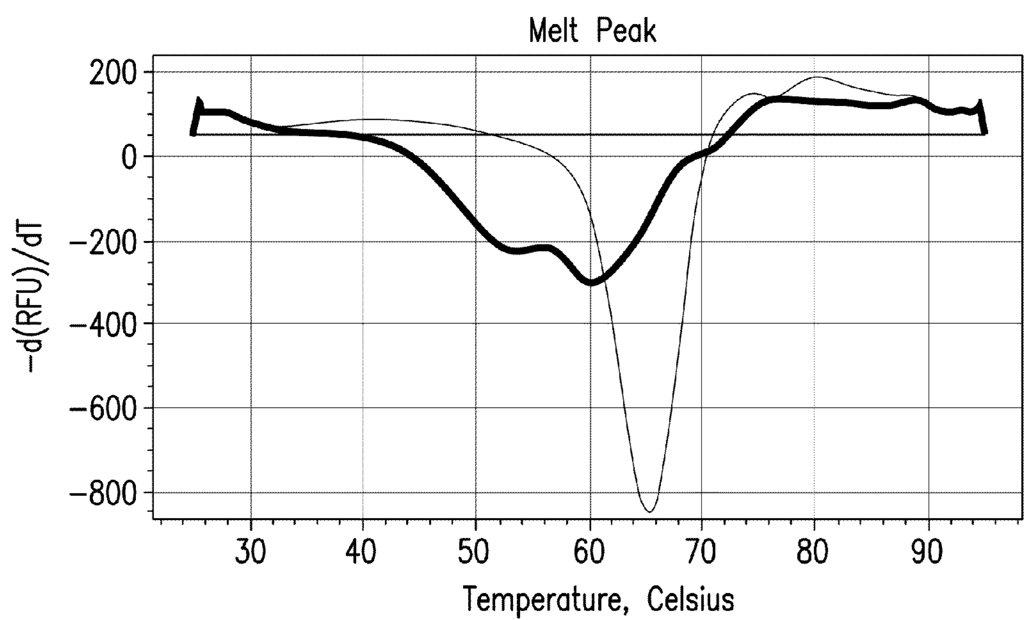
Figure 13A:
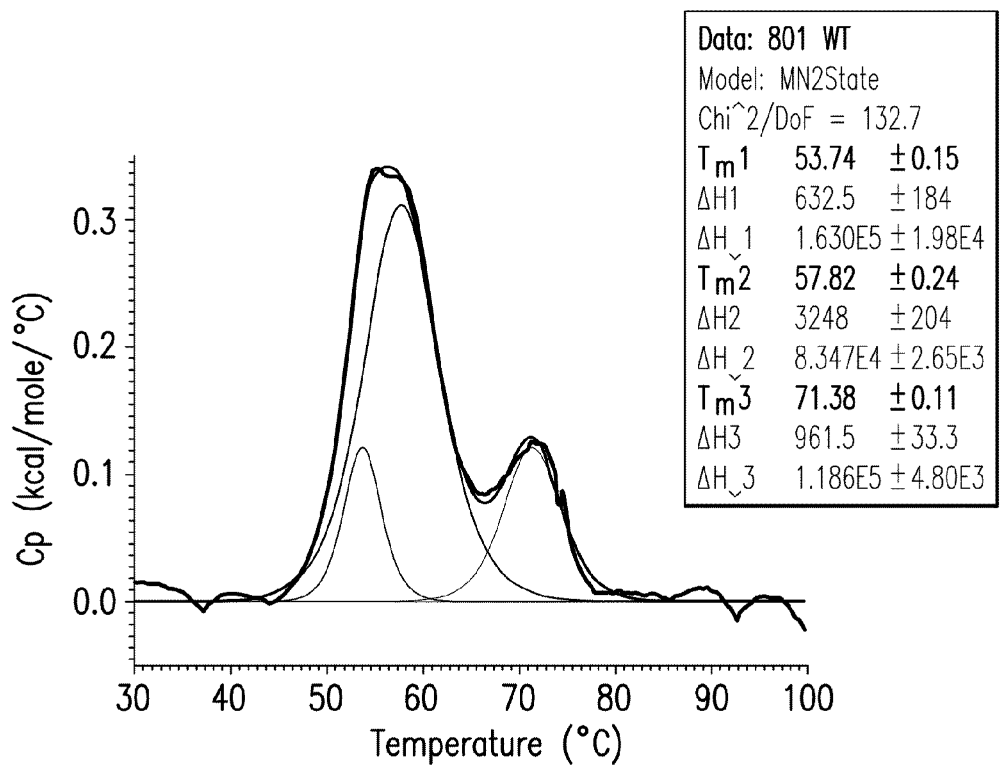
FIGS. 13A-D are graphs from DSC experiments showing the Tm of each molecule.
Figure 13B:
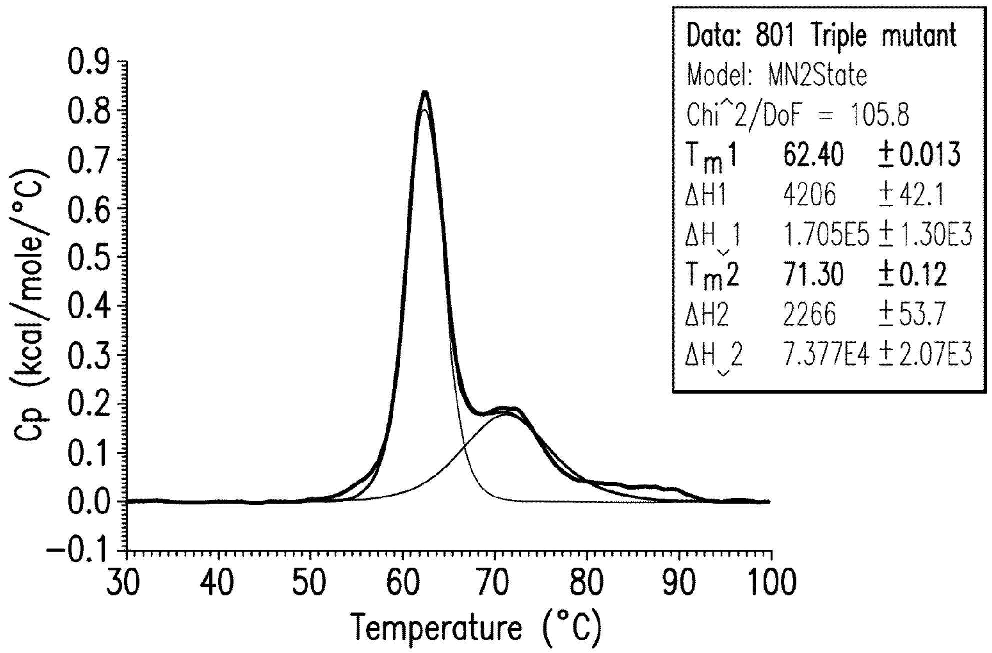
Figure 13C:
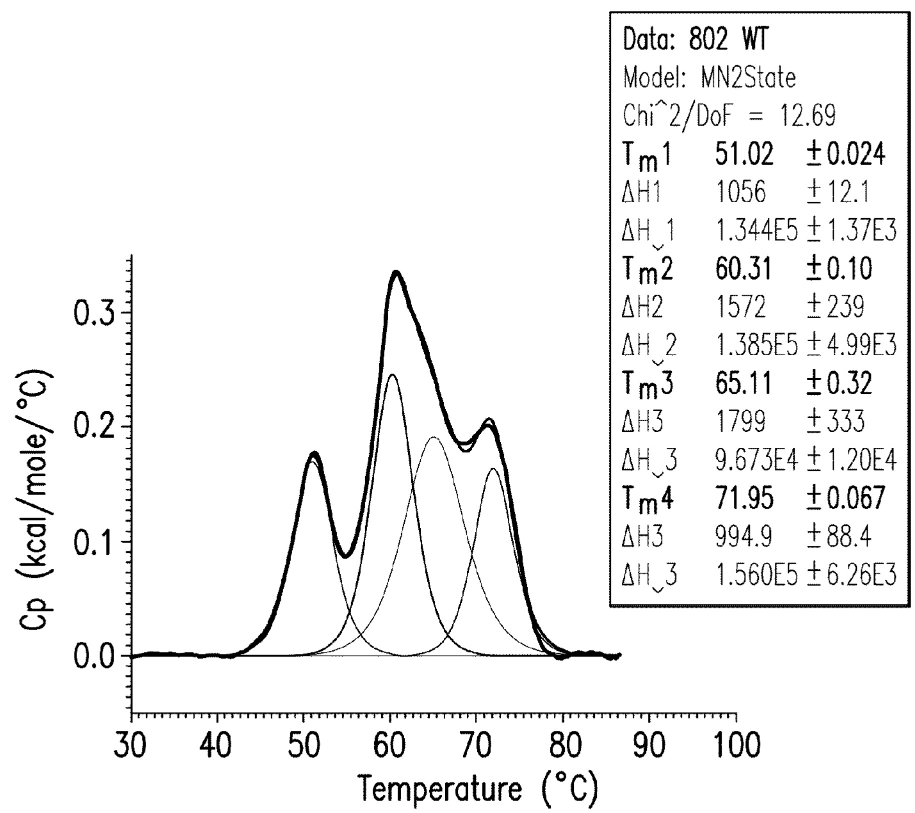
Figure 13D:
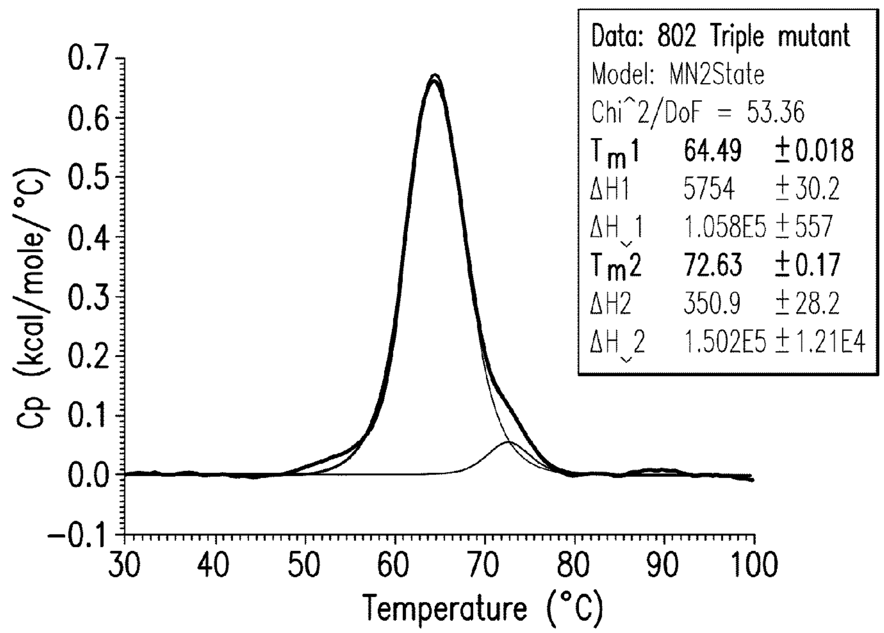

Comparing 801, 802 and their mutant counterparts for DSF and DSC profiling, the peak at 69° C. in DSF or 71-72° C. in DSC were attributed to the peaks from HSA. This was consistent with our in house data (not shown) and literature measurement of Tm of HSA (Michnik et al., 2006, J Thermal Analysis Calorimetry, 84(1) 113-117). DSC and DSF data were mostly comparable, suggesting the consistency of the measurement by different methods (FIG. 11). The triple mutants 801T and 802T demonstrated significant Tm improvement over the wild type counterpart with 7-9° C. increase for 801T over 801 and 12-13° C. increase for 802T over 802 for the first melting point during the temperature ramping. With the triple mutations, Tm of the whole fusion molecule become narrower suggesting more unified Tm among the three different components of the fusion molecule, as shown in FIG. 12 and FIG. 13.

With the exception of 812T, the Tm of the various HSA fusion molecules ranged from 62-66° C., (FIG. 14). In general, Tm tended towards being higher with the orientation of scFv6475 at the N-terminus of the HSA and scFv8168 at the C-terminus of the HSA, as was shown in 802T, 804T, 808T where Tm of 66° C., 65.5° C. and 66° C., respectively were observed. For the opposite orientation, as exemplified by 801T and 803T, recorded Tm was 62° C. and 63° C., respectively.

Figure 15A:
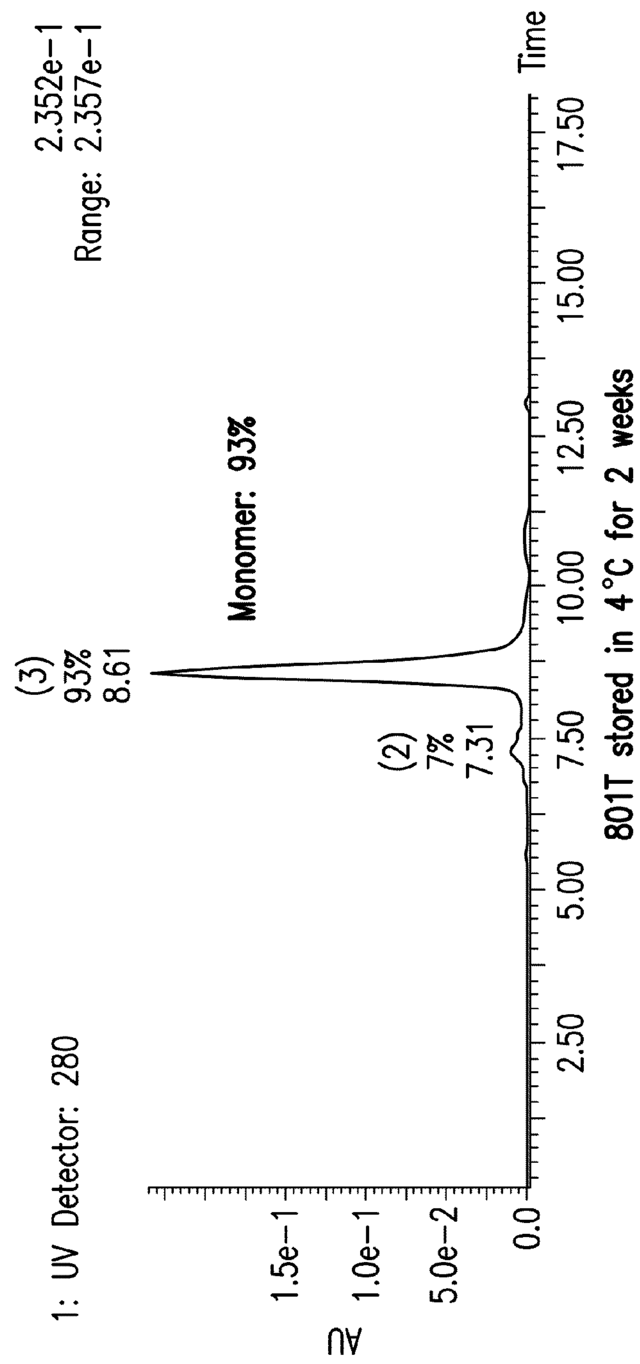
FIGS. 15A-D are graphs showing the elution profiles of 801T and 802T from analytical SEC.
Figure 15B:
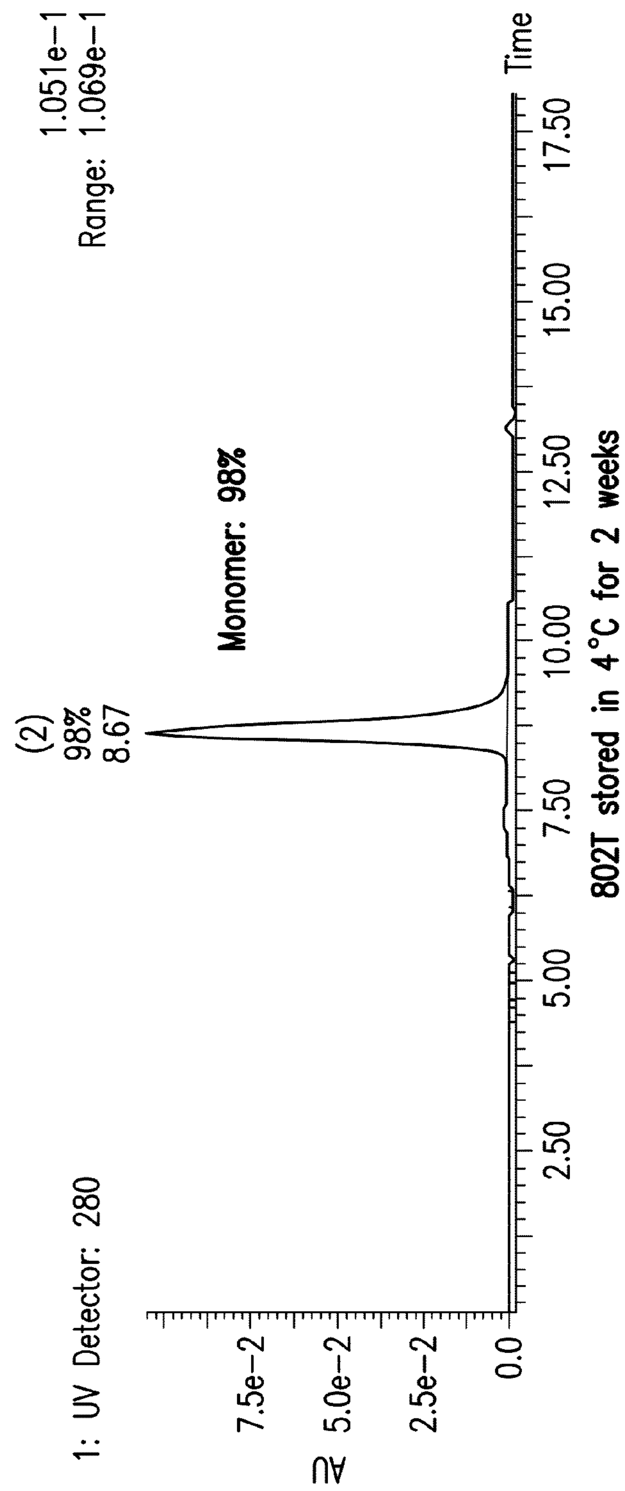
Figure 15C:
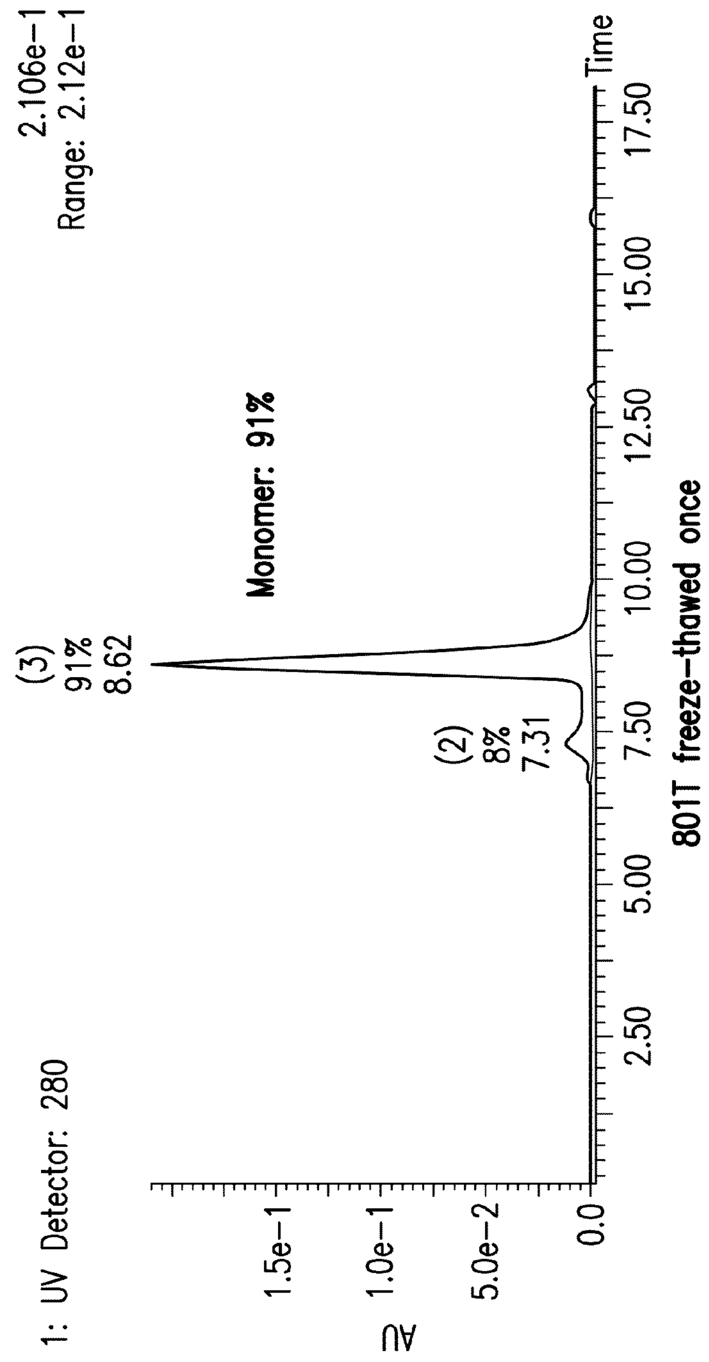
Figure 15D:
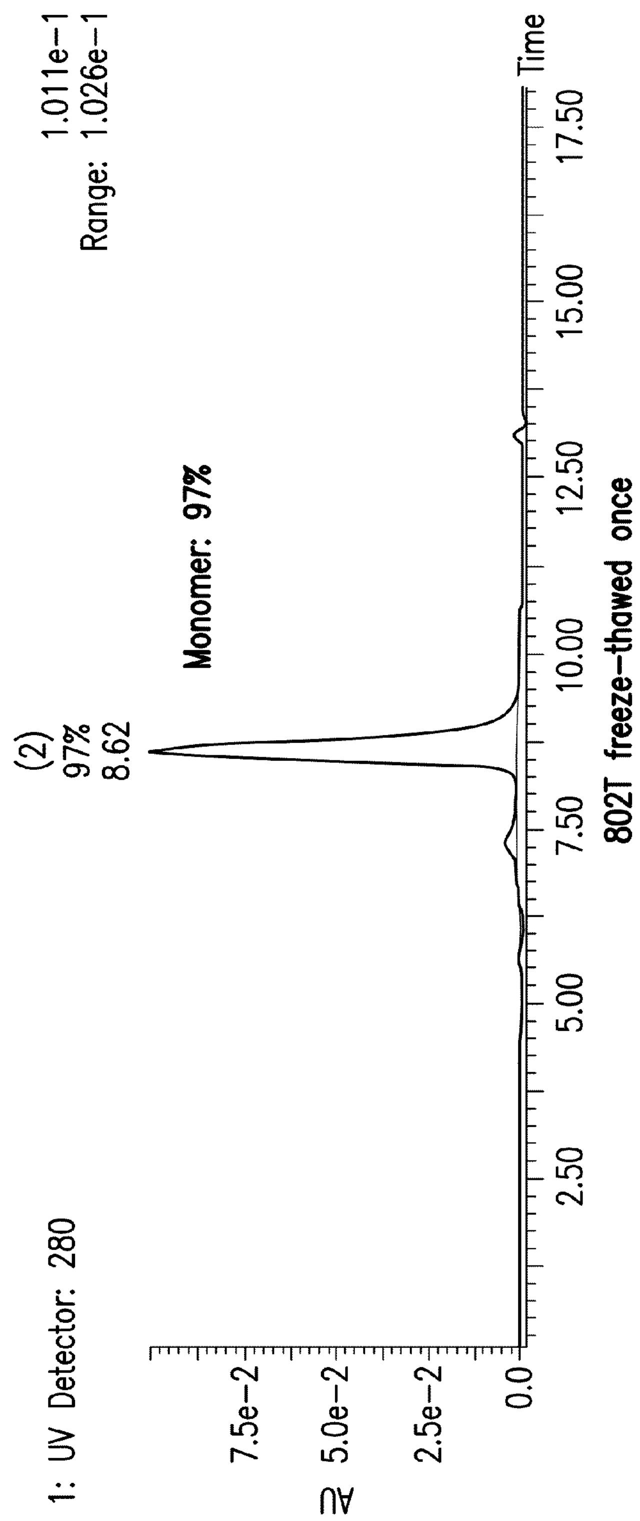
Figure 17A:
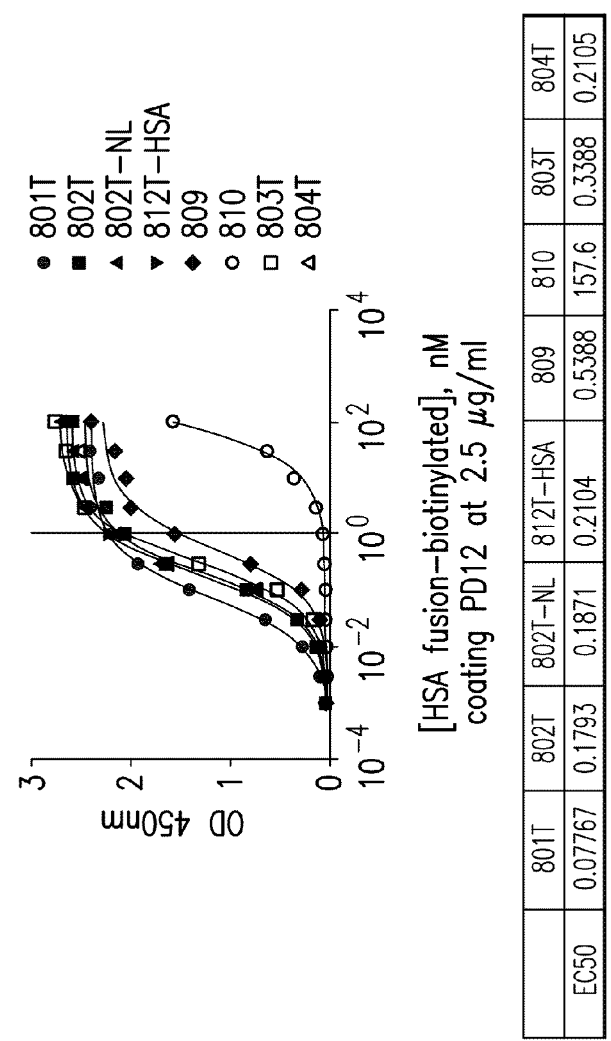
FIGS. 17A-E are graphs showing the binding of anti-LRP6 scFv fusion molecules to LRP6 as determined by ELISA.
Figure 17B:
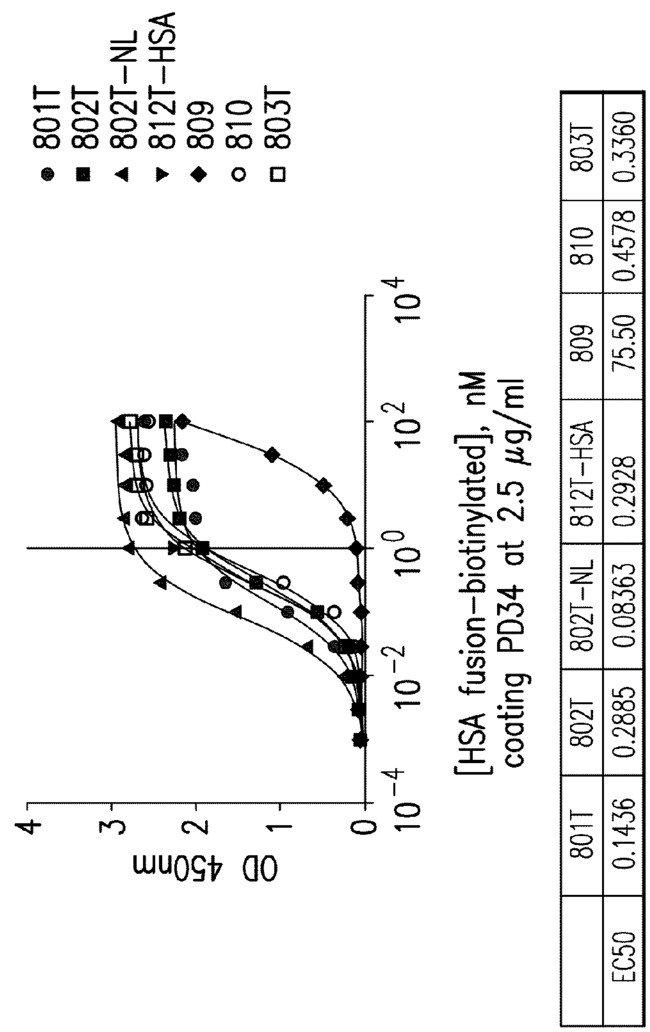
Figure 17C:
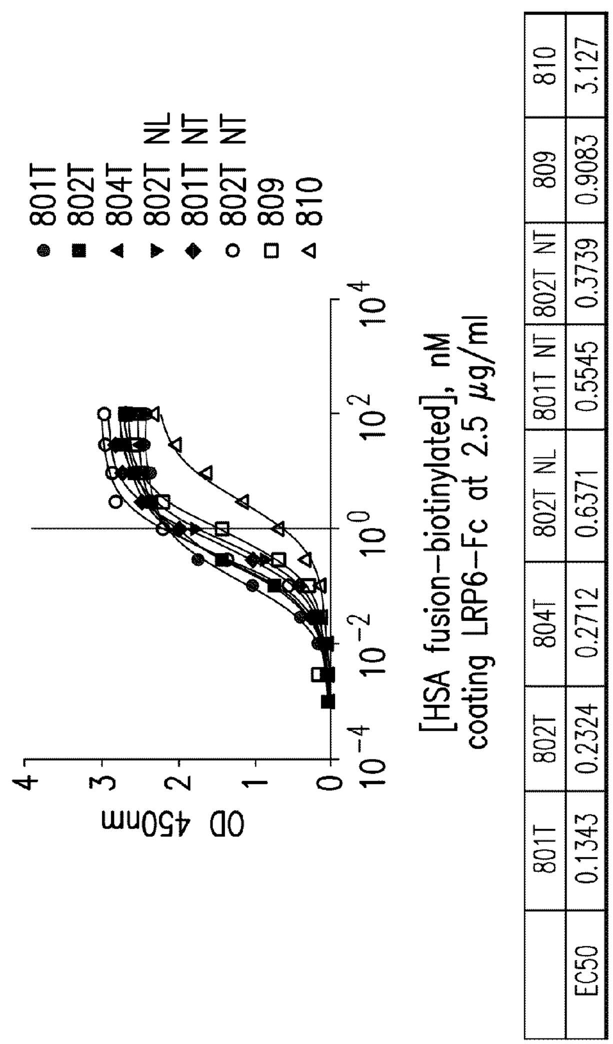
Figure 17D:
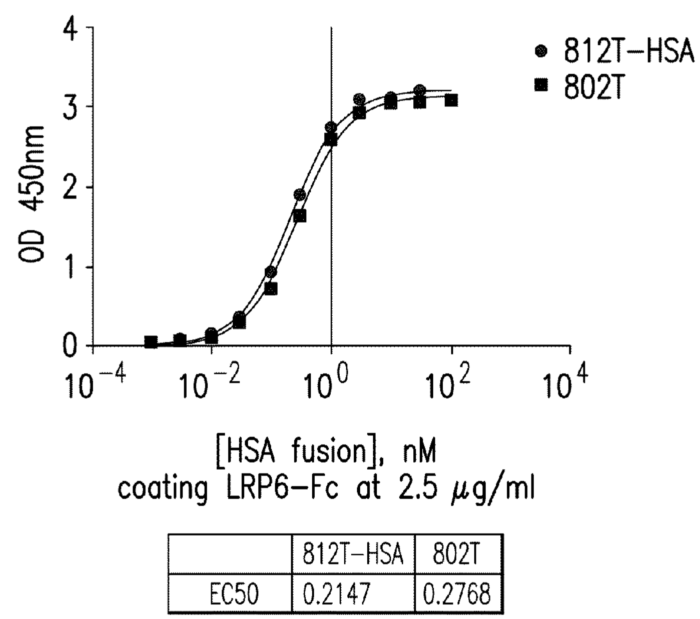
Figure 17E:
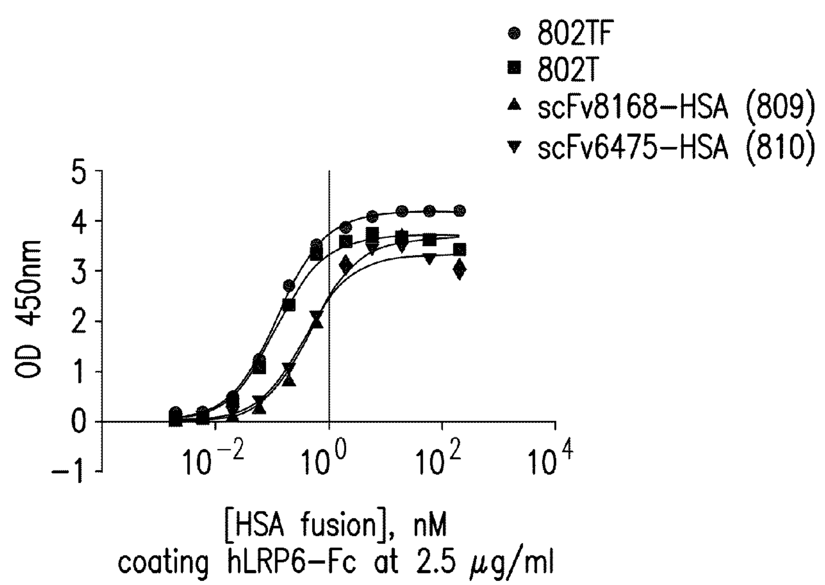

The aggregation propensity was evaluated by analytical SEC. As shown in FIG. 15A, when stored at 4° C. for two weeks, the monomeric fraction of 802T was 98%, while for 801T it was 93%. Upon one freeze and thaw, the monomeric fraction of 802T only dropped slightly to 97%, while for 801T, the monomeric fraction dropped to 91% (FIG. 15B).

After multiple freeze-thaw's (up to 4 times), the monomeric fraction of 802T remained at 99% (n=1). In general, minimal changes in aggregation were observed across several HSA-fusion molecules following multiple freeze-thaw cycles (see FIG. 16), indicating that in general these molecules are stable proteins in terms of aggregation propensity. It was also interesting to note that consistent with the trend in Tm described above, both 802T and 804T showed less aggregation than their sibling molecules, 801T and 803T.

At a concentration of around 2 mg/ml, the monomeric fraction of 802TF was recorded at 97.7%, and 801TF was at 96.6%. When concentrated to around 5 mg/ml, 802TF was recorded at 95.6%, and 801TF at 90.8%. The result was consistent with the general trend of aggregation caused by concentration.

Example 9

Assessment of Binding Activity of HSA Fusion Molecules by ELISA

Materials and Methods

Binding $EC_{50}$ of the various fusion proteins (see FIG. 9) against LRP6 protein was measured by ELISA. In general, Maxisorp plates were coated with 2.5 μg/ml LRP6 antigen (see below for details) at 4° C. overnight. The plate was blocked with 50 μl of 2% BSA for 1 h, and washed five times with the wash solution (PBS with 0.05% (v/v) Tween-20). The samples were diluted with 1% BSA accordingly. The plate was incubated at room temperature for 1 h, and washed for 3 times. Detection was done by adding 50 μl pentaHis-HRP (Qiagen Mat. No. 1014992) at 1:2000 dilution in 1% BSA, incubated at room temperature for 1 h, and washed 3 times. 50 μl of substrate reagent A plus B (R&D Systems) was added, then incubated for 5-20 min depending on the color. The reaction was stopped by adding 25 μl of the stop solution, followed by reading absorbance at 450 nm using a Biotek EL808 plate reader.

In order to measure binding of the fusion molecules in a uniform way, all the molecules were biotinylated to be detected by streptavidin-HRP. Monospecific HSA fusion molecules (scFv8168-HSA (809) and scFv6475-HSA (810)) were used as controls. Overall, three antigens were used: LRP6 propeller domain 1-2 (PD1/2, amino acid residues 19-629 of Accession No. NP002327), LRP6 propeller domain 3-4 (PD3/4, amino acid residues 631-1246 of Accession No. NP002327 and LRP6 propeller domain 1-4-Fc (PD 1-4, LRP6-Fc; R&D Systems, catalog No: 1505-LR).

Competition ELISA

To determine the ability of the biparatopic constructs to bind multiple domains of LRP6, competition ELISAs were performed. For example, to determine if binding to LRP6 propeller domain 1-2 (PD1/2) precluded binding to other LRP6 propeller domains, a Maxisorp plate was coated with PD1/2 at 5 μg/ml at 4° C. overnight. The plate was blocked with 50 μl of 2% BSA for 1 h, and washed five times with the wash solution (PBS with 0.05% (v/v) Tween-20). Biotinylated HSA fusion molecule 802T at 2 nM in 1% BSA were mixed with buffer or different antigens (PD1/2, PD3/4 or LRP6-Fc) at 100 nM in solution. The mixture was incubated for 30 min at room temperature prior to adding to the assay plate. The plate was further incubated at room temperature for 1 h, prior to being washed 3 times with PBS containing 0.05% (v/v) Tween-20. Detection was performed as follows: 50 μl of Streptavidin-HRP (R&D Systems, Cat #890803) at 1:200 dilution in 1% BSA was added and the plate was incubated at room temperature for 1 h, prior to being washed 3 times with PBS containing 0.05% (v/v) Tween-20. 50 μl of substrate reagent A plus B (R&D Systems, Cat #DY999) was added, then incubated for 5-20 min depending on the color. The reaction was stopped by adding 25 μl of the stop solution (R&D systems, cat #DY994), followed by reading absorbance at 450 nm using a Biotek EL808 plate reader.

Both scFv8168 or scFv6475 were used as controls. Similar competition ELISAs were performed using assay plates coated with LRP6 PD3/4 and LRP6 propeller domain 1-4-Fc (PD1-4, LRP6-Fc; R&D Systems, catalog No: 1505-LR).

Results and Discussion

Binding Assessment by ELISA

ELISA binding of several HSA fusion molecules (see FIG. 9 for details) was evaluated and data is shown in FIG. 17. As shown in FIGS. 17A and 17B, 8168-HSA (809) binds PD1/2 with an EC50 of 0.54 nM, whilst binding to PD3/4 is much weaker (EC50: >75 nM). In contrast, scFv 6475-HSA (810) binds to PD3/4 with an EC50 of 0.46 nM, and to PD1/2 with an EC50 of >158 nM. This indicates that scFv8168 and scFv6475 bind differentially to LRP6 PD1/2 and PD3/4, respectively. The binding of various fusion molecules to LRP6-Fc was also compared and results are shown in FIG. 17C. In addition, 812T-HSA was tested for ELISA binding and, as shown in FIG. 17D, binding EC50 estimates appear similar to that of 802T. Furthermore, the binding of 802TF to human LRP6 was also evaluated and the results are presented in FIG. 17E. 802TF also showed similar binding to mouse and cynomolgus monkey LRP6 when evaluated by ELISA.

Competition ELISA

Figure 18A:
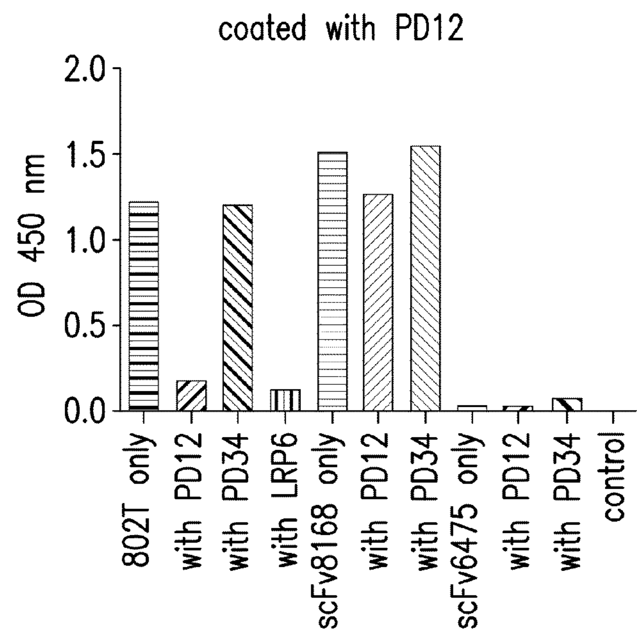
FIG. 18A-D are graphs showing the ability of anti-LRP6 scFv fusion molecules to compete with soluble LRP6 proteins for binding to plate associated LRP proteins by competition ELISA.

To determine if the biparatopic molecules can bind to the target and occupy the two different paratopes in LRP6 full molecule, competition ELISA assays were performed. Firstly, binding and competition was assessed for either antigen PD1/2 or antigen PD3/4. As shown in FIG. 18A either PD1/2 or PD3/4 was coated on the plate surface. Subsequently, 802T at 2 nM was mixed in solution with PD1/2, PD3/4, or LRP6-Fc at 100 nM, and then applied to the wells. The results show that PD1/2 in solution can compete the binding of 802T to PD1/2 coated on the surface, but PD3/4 cannot. In contrast, soluble PD3/4 can compete with 802T for binding binding towards plate bound PD3/4 but not plate bound PD1/2. As expected, LRP6 PD1-4 (LRP6 in FIG. 18A) in solution can compete with 802T for binding towards both PD1/2 and PD3/4 antigens coated on the surface.

Figure 18B:
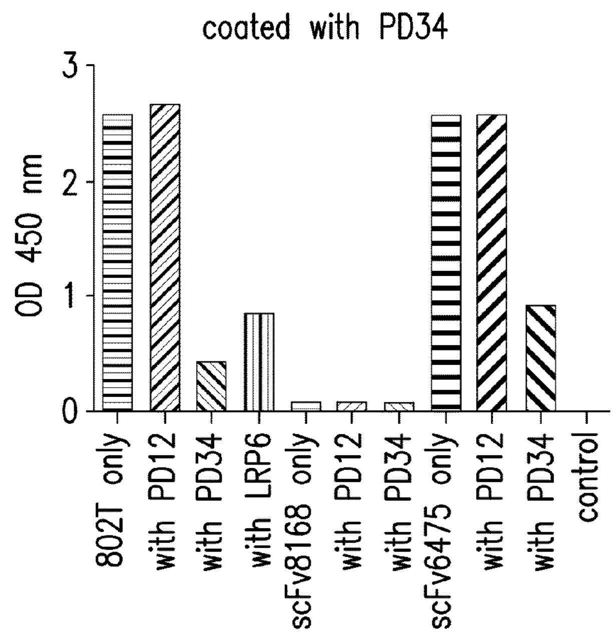
Figure 18C:
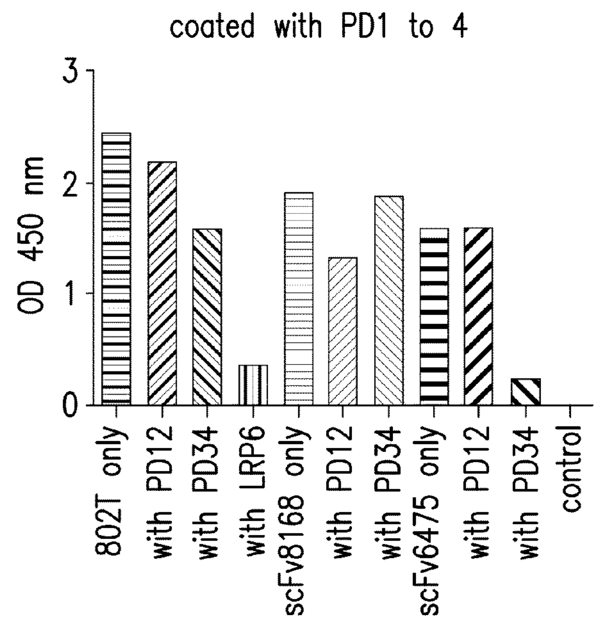
Figure 18D:
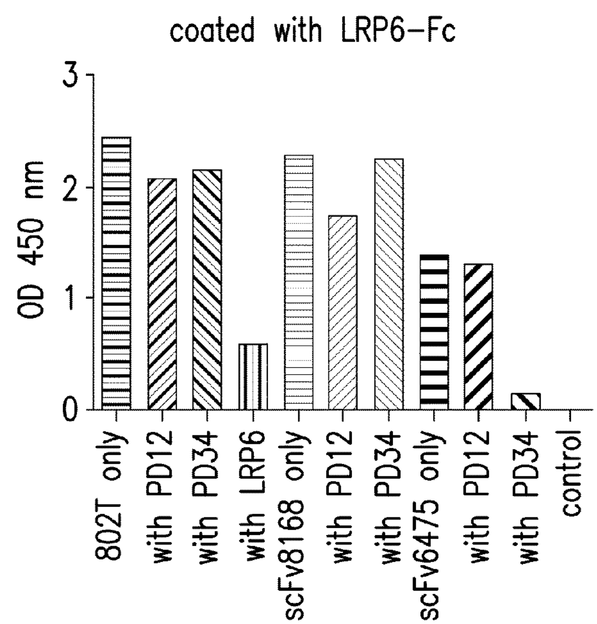

Further experiments were performed in which LRP6 PD1-4 of LRP6-Fc (R&D Systems, catalog No: 1505-LR) were immobilized on the ELISA plate (FIG. 18B). In these studies, neither PD1/2 nor PD3/4 at 100 nM in solution were able to fully compete with 802T for binding to immobilized LRP6. However LRP6 in solution was able to compete with the binding. These results suggest that binding of 802T onto LRP6 can likely occupy the two paratopes simultaneously.

Example 10

Assessment of In vitro Functional Activity of HSA Fusion Molecules in Wnt Ligand Driven Reporter Gene Assays The HSA fusion molecules described in FIG. 9 were evaluated for their ability to inhibit both Wnt1 and Wnt3a-stimulated reporter gene activity using the same methodologies as described in example 4 above.

Figure 19A:
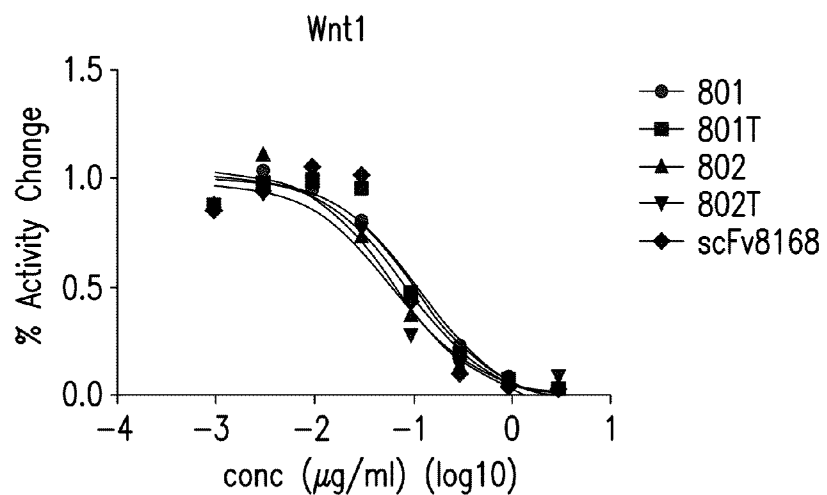
FIGS. 19A-D and FIGS. F-I are graphs that show the activity of anti-LRP6 fusion molecules in Wnt1 and Wnt3a-stimulated HEK293 Wnt reporter gene assays.
Figure 19B:
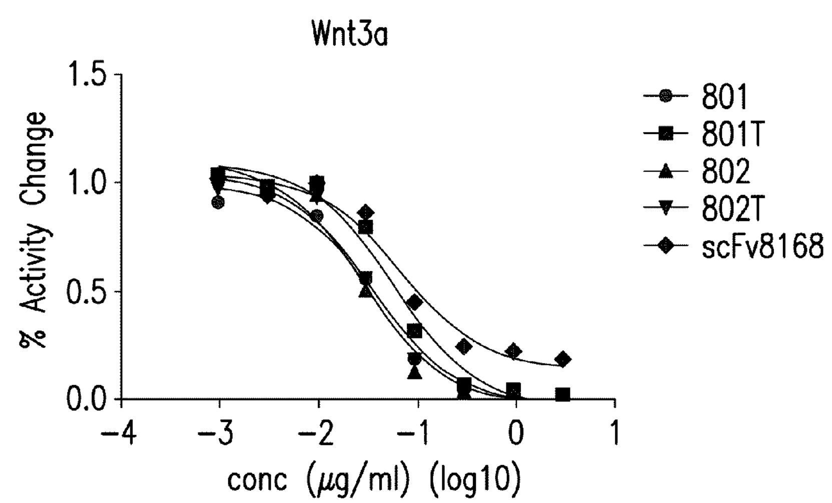
Figure 19C:
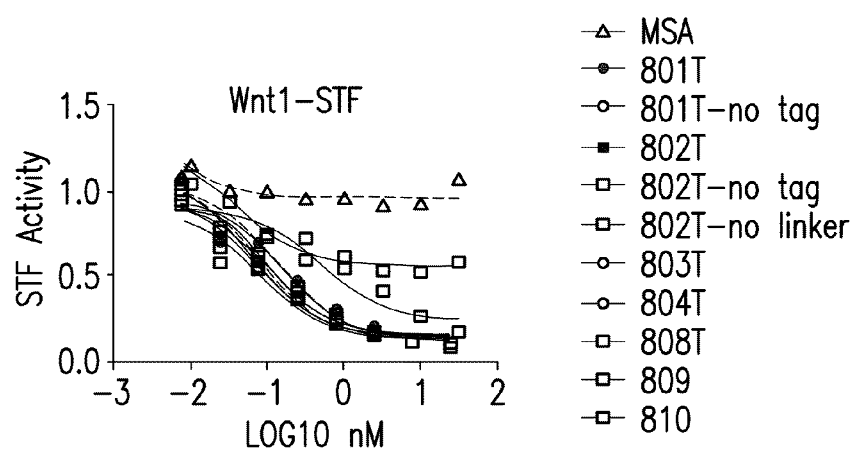
Figure 19D:
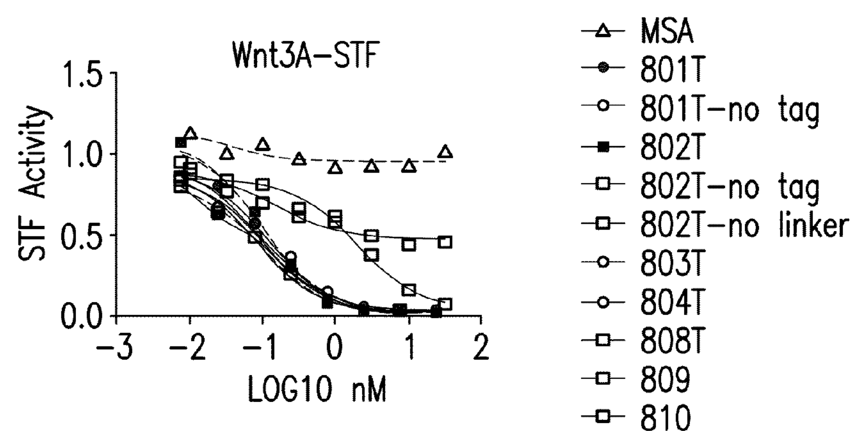
Figure 19F:
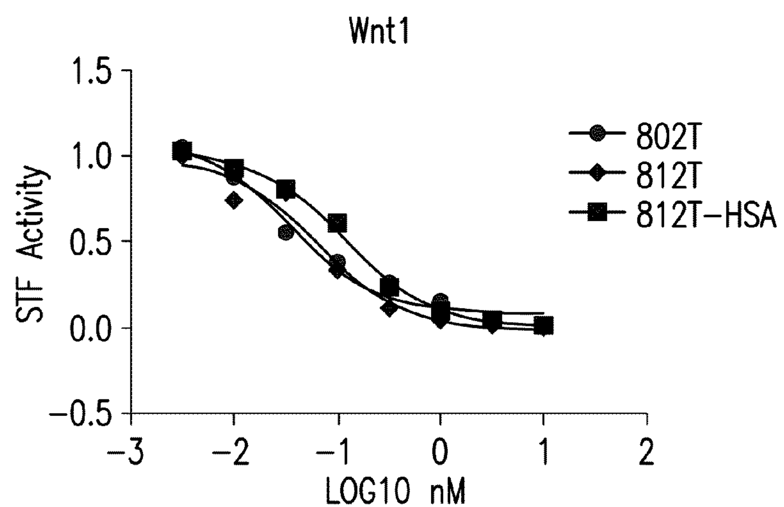
FIG. 19E is a table summarizing the potency of the anti-LRP6 fusion molecules.
Figure 19G:
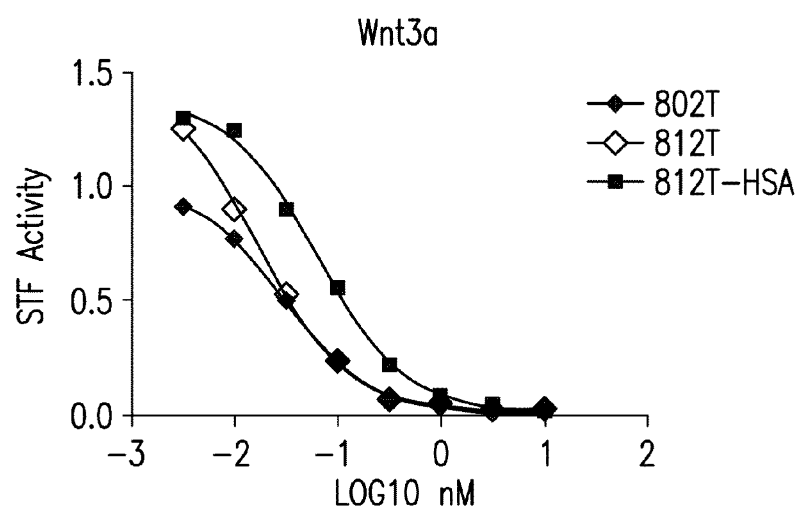
Figure 19H:
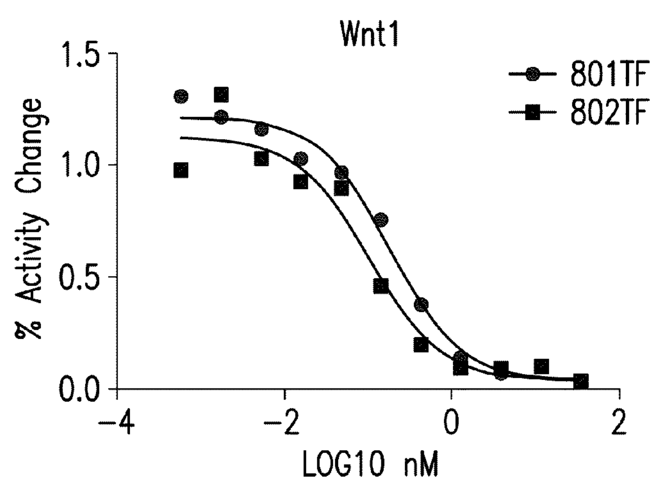
Figure 19I:
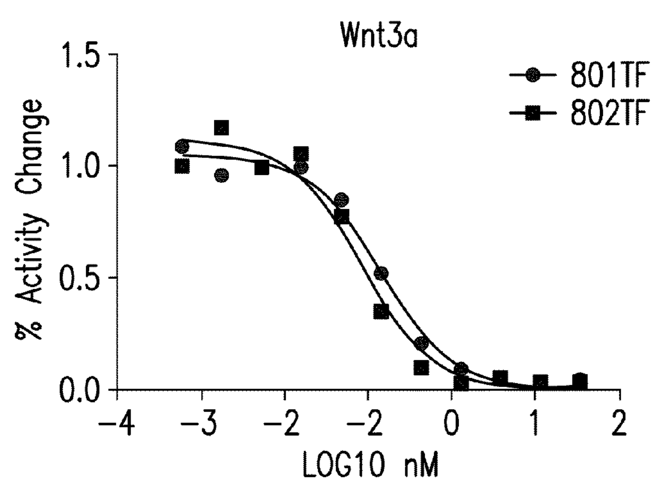

801, 801T, 802 and 802T were tested using the transiently transfected cell format and all were found to be potent inhibitors of both Wnt1 and Wnt3a-mediated signaling (FIG. 19A). Additional molecules were also evaluated using this assay format (FIG. 19B and FIG. 19C) and the data generated demonstrate that alteration of the linker and presence/absence of the His tag does not affect the potency of the anti-LRP6 HSA-fusion molecules. Similar data were obtained when the various anti-LRP6 HSA-fusion molecules were tested using the co-culture format (not shown). The potency of 812T, in which the 2 scFv moieties are fused in tandem and 812T-HSA, in which the 2 scFv moieties are fused in tandem followed by fusion to HSA, was found to be similar to that of 802T (FIG. 19D). These results are consistent with the binding ELISA data reported in example 9 and suggest that the anti-LRP6 scFv's can retain potency in several orientations and with the HSA fusion at different positions. Versions of 801T and 802T devoid of both the His tag and any linkers were also generated—when tested in the reporter gene assays, potency was found to be similar to 802T for 801TF and an increase in potency was observed for 802TF (FIG. 19E).

Figure 20A:
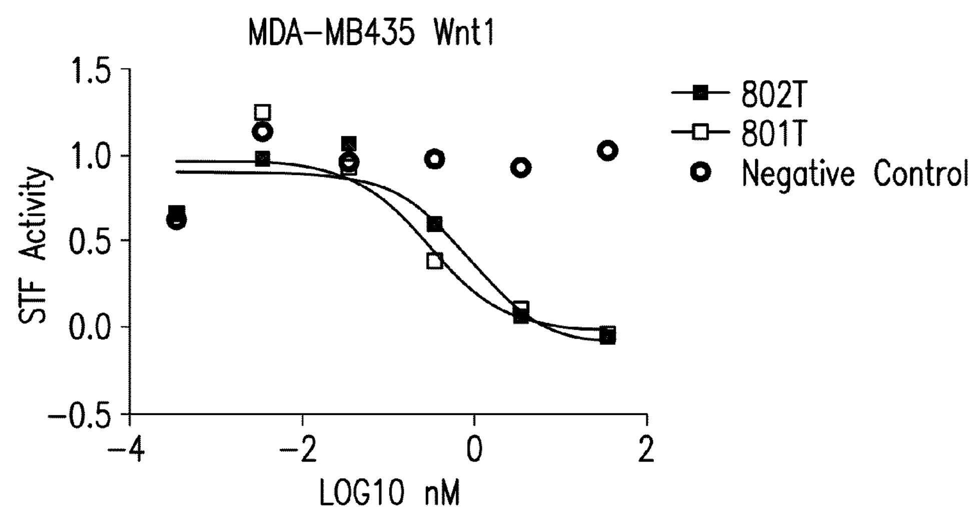
FIGS. 20A-B are graphs that shows the activity of anti-LRP6 fusion molecules in Wnt1 and Wnt3a-stimulated MDA-MB435 Wnt reporter gene assays.
Figure 20B:
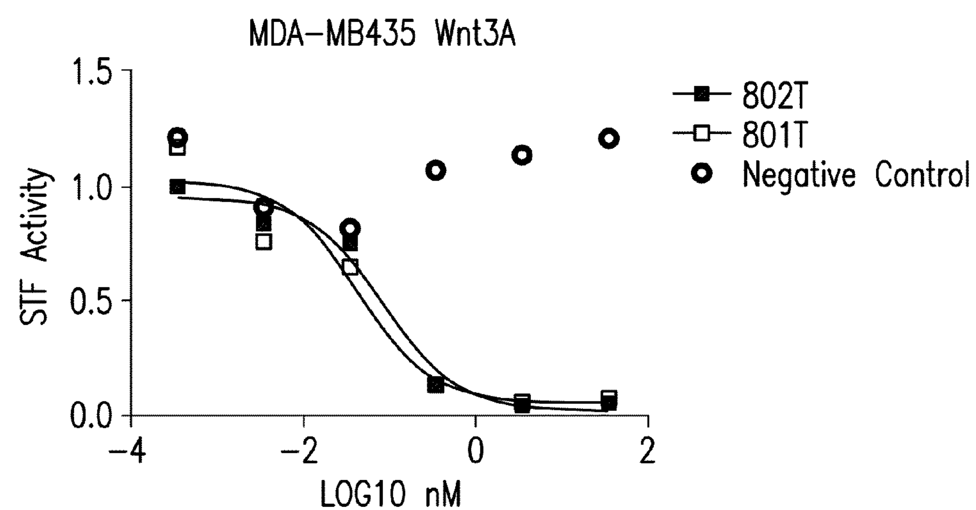

In addition to HEK293 cells, the activity of 801T and 802T to inhibit Wnt1 and Wnt3a-induced Wnt signaling in MDA-MB435 melanoma cells was determined. In these studies, MDA-MB435 cells stably infected with STF reporter were stimulated with Wnt1 and Wnt3a in the co-culture format. Lentivirus of the STF reporter was packaged in HEK293T cells and viral supernatant used to infect MDA-MB435 cells. A pool of stably selected clones were used for reporter gene co-culture assays as described in Example 4 above. In addition to HEK293 cells, both 801T and 802T were potent inhibitors of Wnt signaling in MDA-MB435 cells (FIG. 20). This data further suggests that the ability of the anti-LRP6 HSA fusion molecules to inhibit Wnt signaling is not limited to HEK293 cells and that these molecules have the potential to inhibit Wnt signaling in a broad range of settings.

Example 11

Evaluation of Pharmacokinetic and Pharmacodynamic Properties of Anti-LRP6 Serum Albumin Constructs in vivo The pharmacokinetic (PK) and pharmacodynamic (PD) properties of several of the anti-LRP6 HSA constructs was evaluated in both MMTV-Wnt1 tumor bearing mice and non-tumor bearing rats. (DeAlmeida et al., (2007) Cancer Res. 67, 5371-5379); Ettenberg et al., (2010) Proc. Nat. Acad. Sci. 107, 15473-15478; International Serial No. PCT/EP2008/064821 filed Oct. 31, 2008; PCT/EP2011/057200, filed May 6, 2011; and PCT/EP2011/057202, filed May 6, 2011, the contents of which are incorporated herein by reference in their entirety)

Figure 21A:
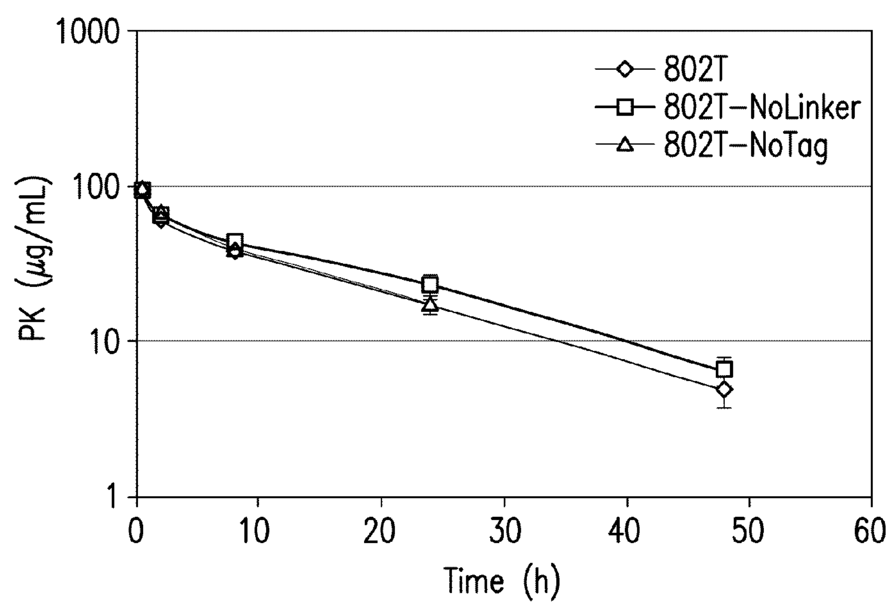
FIG. 21 (A) is a graph showing a single IV dose of anti-LRP6 human serum albumin fusion molecules that bind to β-propeller 1 region at 5 mg/kg in MMTV-Wnt1-tumor bearing mice. (B) is a graph showing the effect on Axin2 mRNA of anti-LRP6 human serum albumin fusion molecules that bind to β-propeller 1 region at 5 mg/kg in an MMTV-Wnt1 tumor bearing mouse.
Figure 21B:
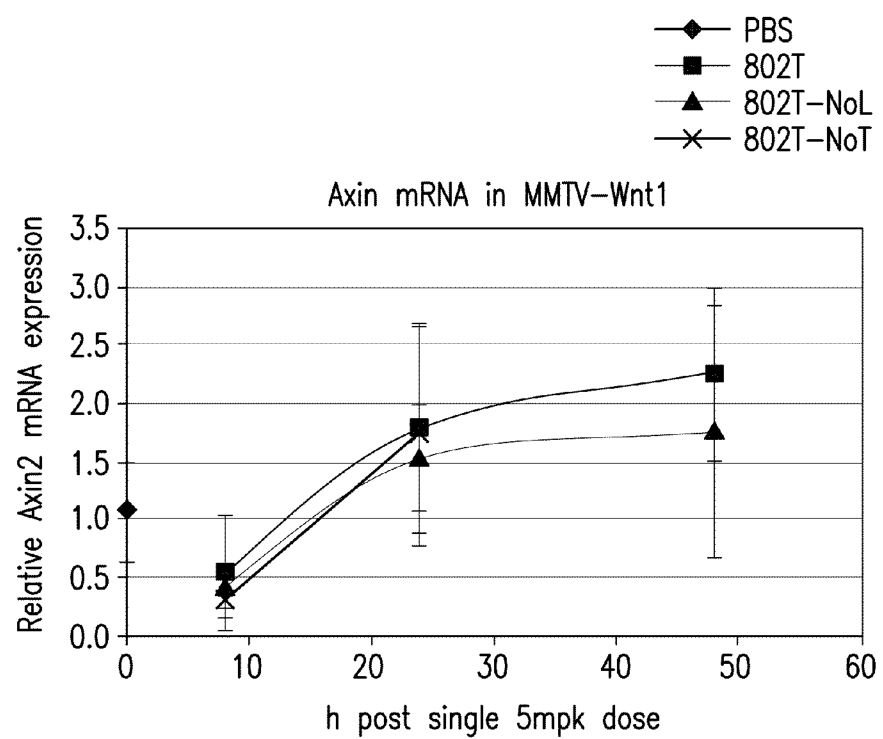

To determine the PK properties of 802T, 802T no linker and 802T no his tag, MMTV-Wnt1 tumor bearing nude mice were dosed i.v. with a single dose of 5 mg/kg of the above molecules. Serum concentrations of the HSA constructs were determined by mass spectrometry using the methodology described in example 5 at multiple time points after completion of the infusion (0.5, 2, 8, 24, and 48 h, respectively) and results are shown in FIG. 21A. The PK properties of all the molecules was similar, with a half-life of around 14 h. In addition, samples were taken for the analysis of Wnt signaling inhibition at the 7, 24 and 48 h time points. In these samples, the level of mRNA expression of the β-catenin target gene Axin2 was analyzed and results are shown in FIG. 21B. Consistent with data obtained with the anti-LRP6 Fab MSA constructs described in example 5 above and with other anti-LRP6 targeting agents, decreases in Axin2 mRNA expression were observed, the magnitude of which was dependent upon the serum concentration of the anti-LRP6 HSA molecules Ettenberg et al., (2010) Proc. Nat. Acad. Sci. 107, 15473-15478; International Serial No. PCT/EP2008/064821 filed Oct. 31, 2008; PCT/EP2011/057200, filed May 6, 2011; and PCT/EP2011/057202, filed May 6, 2011, the contents of which are incorporated herein by reference in their entirety). Consistent with the PK data, all 3 molecules (802T, 802T no linker and 802T no his tag) exhibited similar changes in Axin2 mRNA levels (FIG. 21B).

Figure 22:
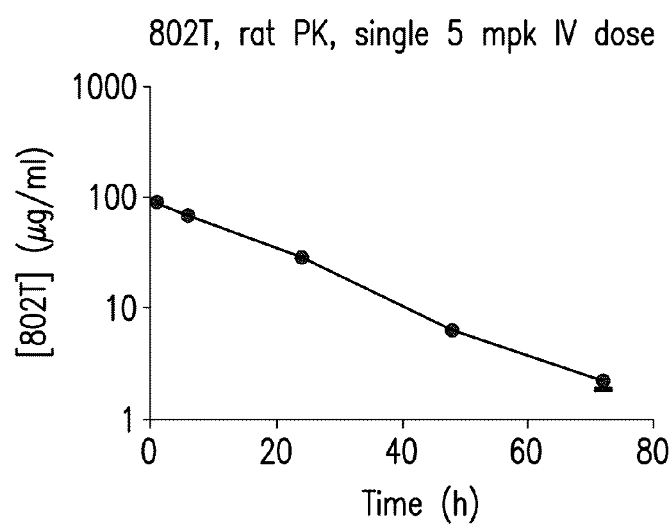
FIG. 22 is a graph showing a single IV dose of anti-LRP6 human serum albumin fusion molecules that bind to β-propeller 1 region at 5 mg/kg in naive rats.

To evaluate the PK properties of 801T, 802T and 802T no his tag, naive Sprague-Dawley rats were dosed IV with a single dose of 5 mg/kg of the above molecules. Serum concentrations of the HSA constructs were determined by mass spectrometry as described in example 5 at multiple time points after completion of the infusion (1, 6, 24, 48, 72, 96 and 192 h, respectively) and results for 802T are shown in FIG. 22. Note that no values are reported for the 96 and 192 h time points as they were below the limit of detection of the assay.

The PK properties of 802TF in MMTV-Wnt1-tumor bearing nude mice were also evaluated. In these studies, MMTV-Wnt1 tumor bearing nude mice were dosed i.v. with a single dose of 6 or 24 mg/kg of 802TF and serum concentrations were determined by mass spectrometry using the methodology described in example 5 at multiple time points after completion of the infusion (1, 2, 8, 24, 48 and 72 h, respectively). The terminal half-life was found to range from 18 h following the 6 mg/kg dose to 24 h following the 24 mg/kg dose.

Example 12

Figure 23A:
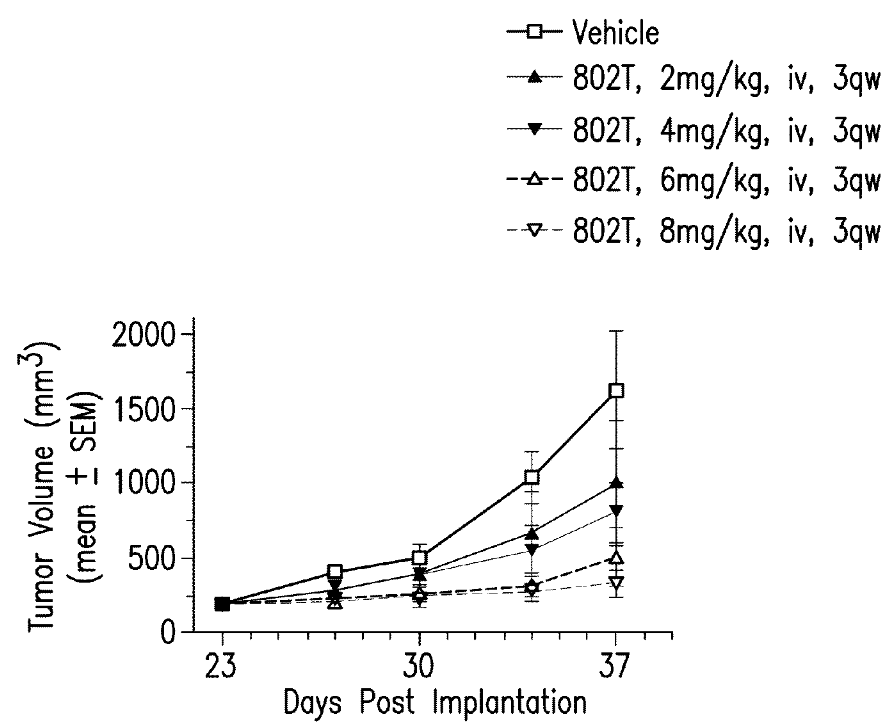
FIG. 23 (A) is a graph showing that a Propeller 1 anti-LRP6 Fab human serum albumin fusion protein causes anti-tumor effects in an in vivo tumor MMTV-Wnt1 model (B) is a bar chart showing the effect on MMTV-Wnt1 tumor Axin2 mRNA expression following the various treatments at the end of the study.
Figure 23B:
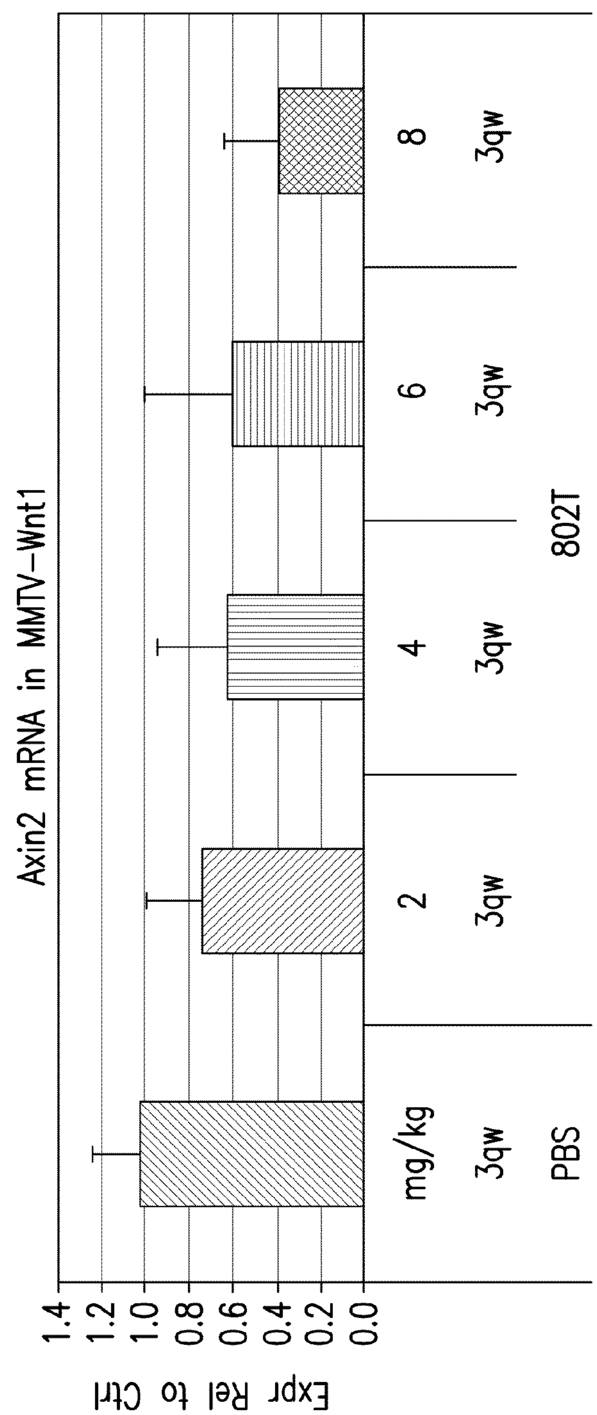

Evaluation of in vivo Anti-Tumor Efficacy of Anti-LRP6 Serum Albumin Constructs in MMTV-Wnt1 Allograft Model Anti-tumor activity of anti-LRP6 Propeller 1+3 scFv6475 (VH: M95F)-HSA-scFv8168 (VH: S34M and S49A) 802T was evaluated in the MMTV-Wnt1 allograft model. MMTV-Wnt1 tumor fragments were implanted subcutaneously (SC) into female nude mice. 23 days after implantation, mice carrying MMTV-Wnt1 tumors (n=5, average 185 $mm^3$; range: 115-265 $mm^3$) were treated with vehicle (PBS, intravenously (IV), weekly (qw) or LRP6-Propeller 1+3 802T (at 2, 4, 6, and 8 mg/kg, iv, three times a week (3 qw) and tumors callipered twice per week (FIG. 23A). 802T demonstrated dose dependent antitumor activity reaching T/C of 10% at 8 mg/kg 3 qw ($p<0.05$ vs. vehicle). In addition, the effect of the various doses of 802T on Wnt-signaling in the MMTV-Wnt1 tumors was evaluated at the end of the study. Tumors were collected 7 h after the last dose and mRNA expression of the β-catenin target gene Axin2 was evaluated. As shown in FIG. 23B, consistent with the anti-tumor effect, decreases in Axin2 mRNA expression were observed.

Figure 24A:
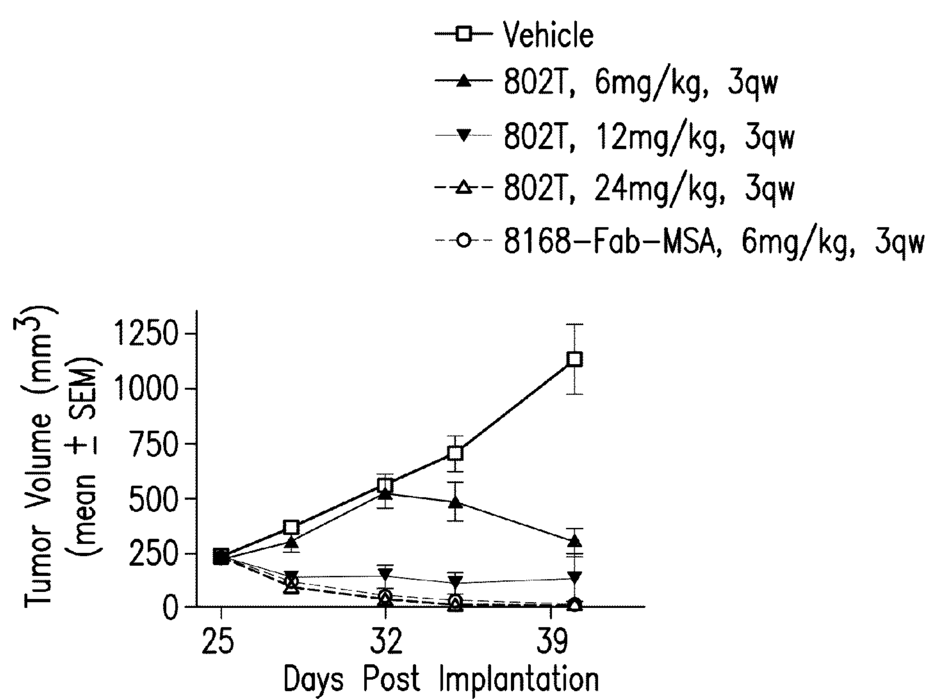
FIG. 24 (A) is a graph showing that a Propeller 1 anti-LRP6 Fab human serum albumin fusion protein causes regressions in an in vivo tumor MMTV-Wnt1 model; (B) is a bar chart showing the effect on MMTV-Wnt1 tumor Axin2 mRNA expression following the various treatments at the end of the study; (C) is a graph showing that 802TF causes dose-dependent anti-tumor activity in an in vivo tumor MMTV-Wnt1 model.
Figure 24B:
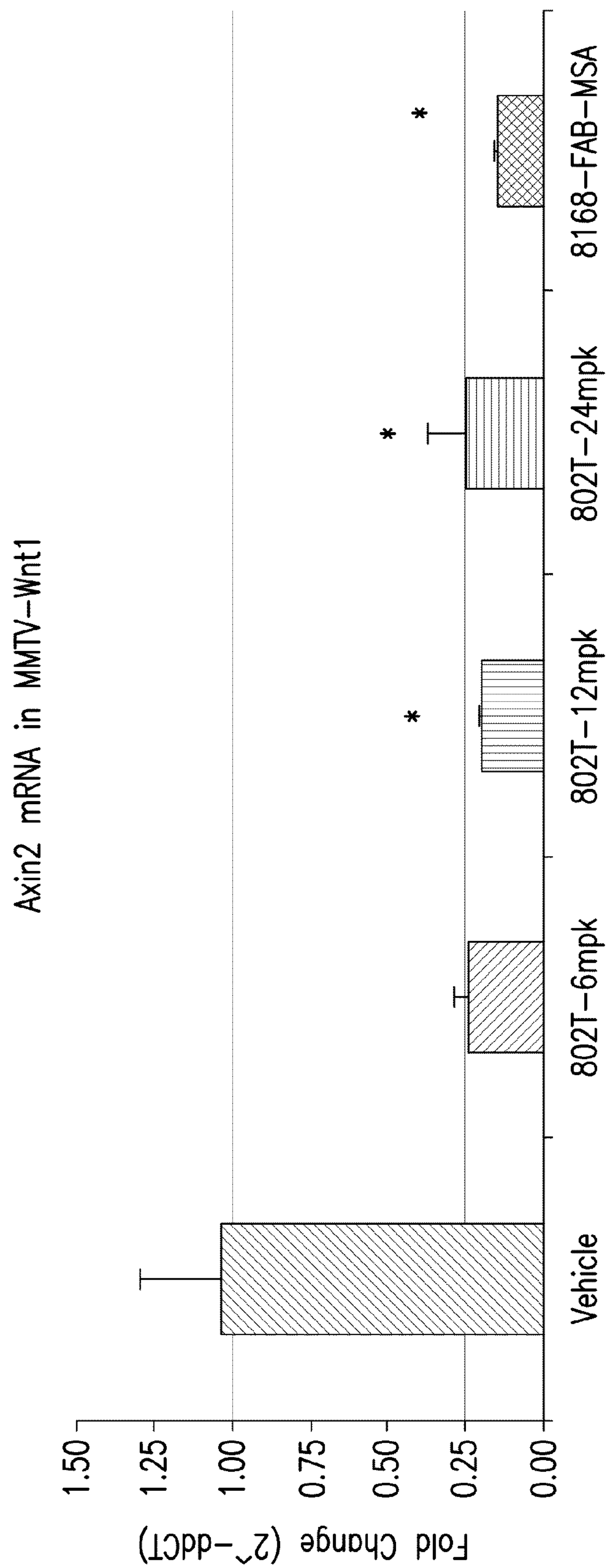

In additional studies, the anti-tumor activity of 802T was evaluated relative to anti-LRP6 MOR08168-Fab-MSA in the MMTV-Wnt1 allograft model. MMTV-Wnt1 tumor fragments were implanted subcutaneously (SC) into female nude mice. 23 days after implantation, mice carrying MMTV-Wnt1 tumors (n=6, average 236 $mm^3$; range: 124-402 $mm^3$) were treated with vehicle (PBS, intravenously (IV), weekly (qw), 802T (6, 12, and 24 mg/kg, IV, three times a week (3 qw), and LRP6 propeller 1 8168-Fab-MSA (6 mg/kg, IV, 3 qw) and tumors callipered twice per week (FIG. 24A). 802T demonstrated dose-dependent antitumor activity reaching T/C of 8% when dosed at 6 mg/kg 3 qw and 44% and 98% regression when dosed at 12 mg/kg and 24 mg/kg 3 qw, respectively (both $p<0.05$ vs. vehicle). LRP6-Propeller 1 8168-Fab-MSA dosed at 6 mg/kg 3 qw resulted in 94% regression ($p<0.05$ vs. vehicle). As described above, the effect of the various doses of 802T and anti-LRP6 MOR08168 Fab-MSA on Wnt-signaling in the MMTV-Wnt1 tumors was evaluated at the end of the study. Tumors were collected 7 h after the last dose and mRNA expression of the β-catenin target gene Axin2 was evaluated. As shown in FIG. 24B, consistent with the anti-tumor effect of the molecules, decreases in Axin2 mRNA expression were observed.

Figure 24C:
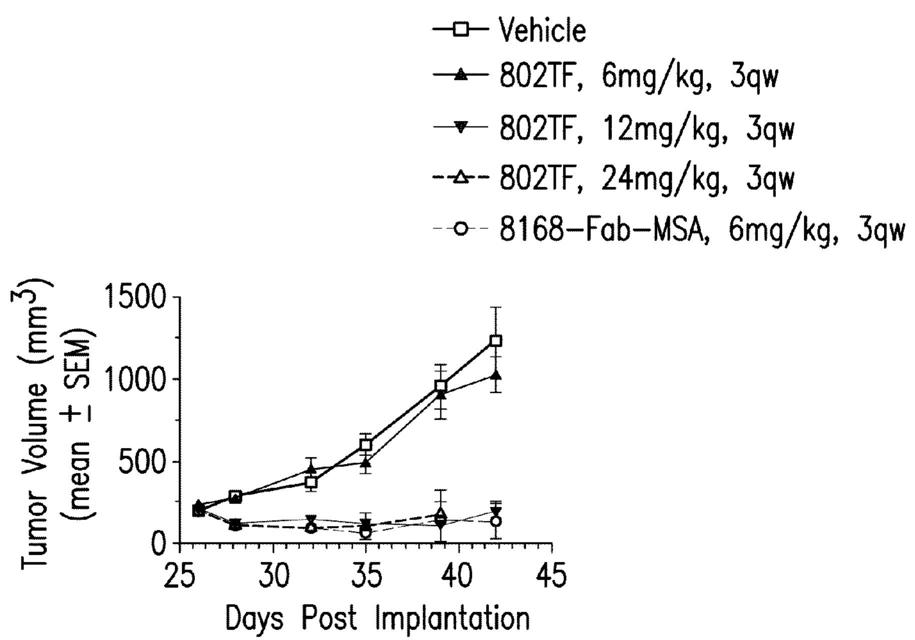

Anti-tumor activity of 802TF was evaluated in the MMTV-Wnt1 allograft model. MMTV-Wnt1 tumor fragments were implanted subcutaneously (SC) into female nude mice. 26 days after implantation, mice carrying MMTV-Wnt1 tumors (n=6, average 204 $mm^3$; range: 127-384 $mm^3$) were treated with vehicle (PBS, intravenously (IV), weekly (qw), 802TF (at 6, 12, and 24 mg/kg, IV, three times a week (3 qw), and anti-LRP6 MOR08168-Fab-MSA (6 mg/kg, IV, 3 qw) and tumors callipered twice per week (FIG. 24C). 802TF demonstrated dose dependent antitumor activity reaching ~45% regression at day 35 when dosed at 12 or 24 mg/kg 3 qw ($p<0.05$ vs. vehicle). As described above, the effect of the various doses of 802TF and anti-LRP6 MOR08168 Fab-MSA on Wnt-signaling in the MMTV-Wnt1 tumors was evaluated at the end of the study. Tumors were collected 3 and 7 h after the last dose and mRNA expression of the β-catenin target gene Axin2 was evaluated.

Example 13

Figure 26B:
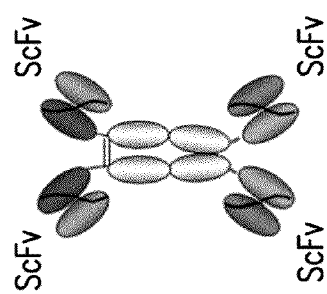
FIGS. 26A-B are schematics of anti-LRP6 Fc-fusion molecules.
Figure 26A:
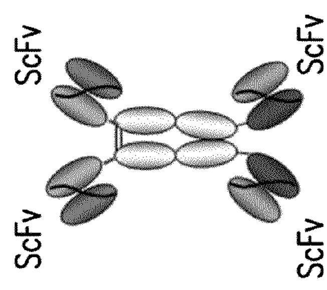

Generation and Binding Properties of Anti-LRP6 Biparatopic Fc Based Fusion Molecules In addition to HSA-fusions, Fc based biparatopic molecules were also generated. In these molecules, the thermostability enhanced mutants of scFv 8168 or scFv6475 were fused to the N-terminal of CH2 or C-terminal of CH3 to make scFv-Fc-scFv fusions as shown in FIG. 25 and FIG. 26 to generate 911T (SEQ ID NO: 297) and 912T (SEQ ID NO: 299), respectively.

Figure 27:
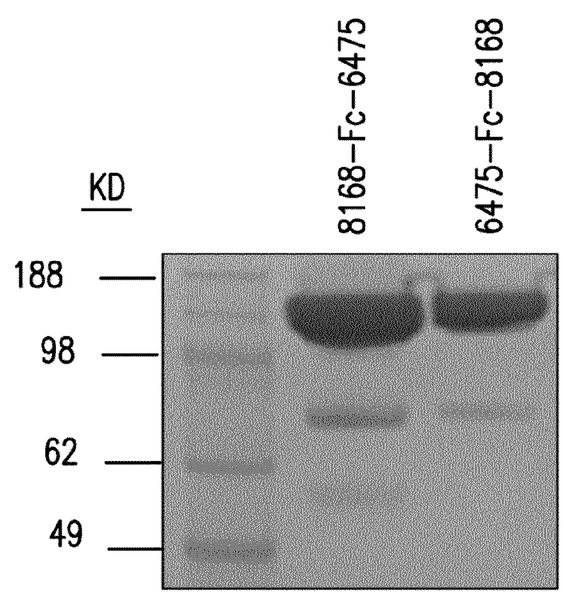
FIG. 27 is a photograph of an SDS-PAGE gel showing purified anti-LRP6 bispecific Fc fusion molecules.
Figure 28A:
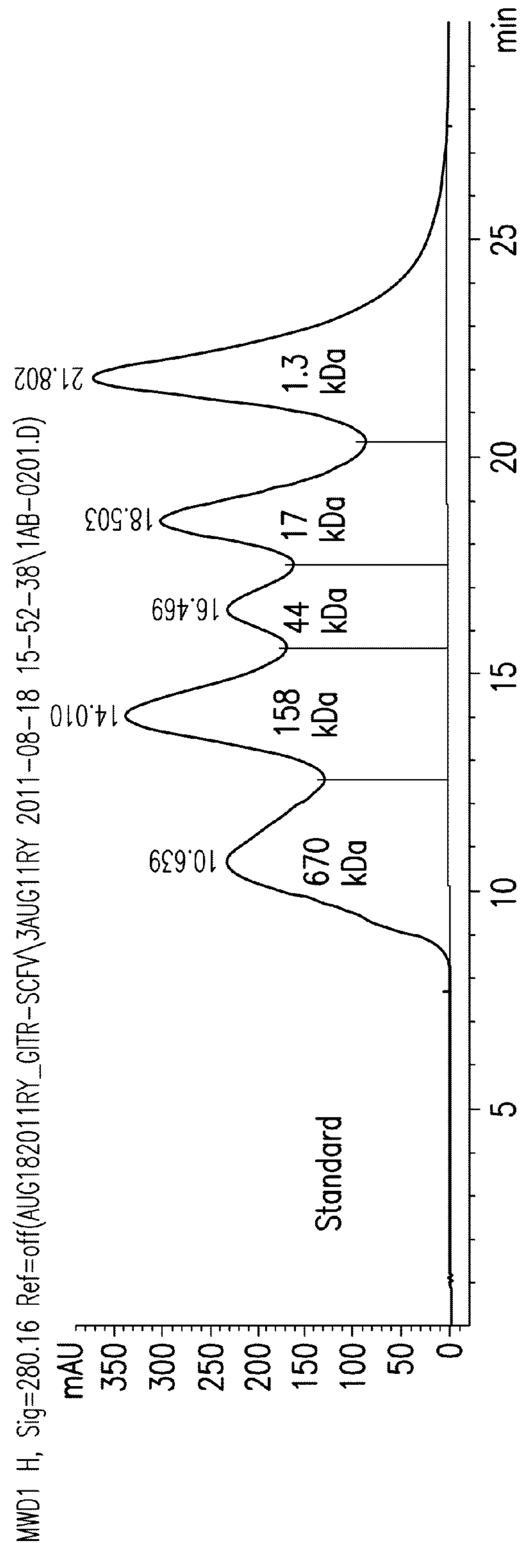
FIGS. 28A-B are graphs showing the elution profile of 911T from analytical SEC.
Figure 28B:
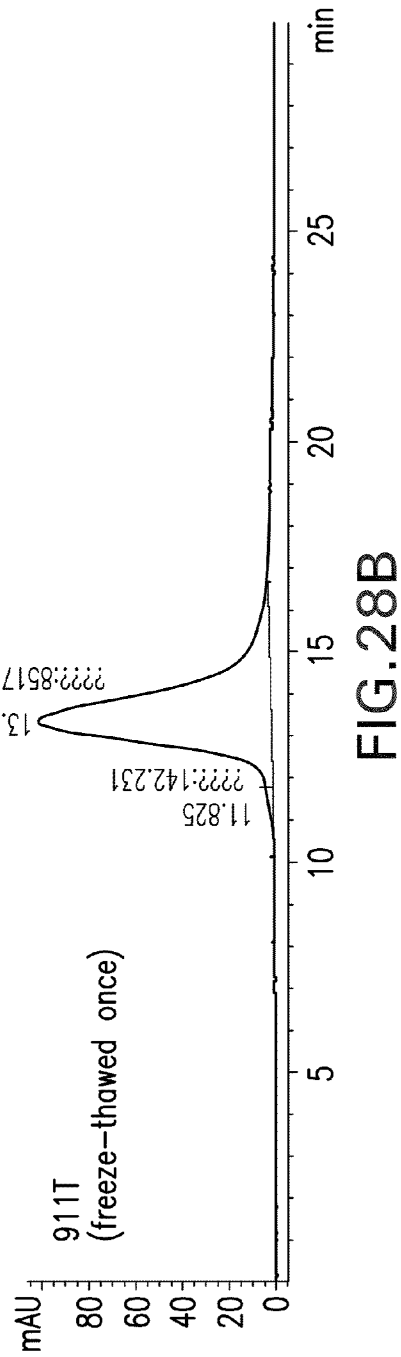
Figure 29A:
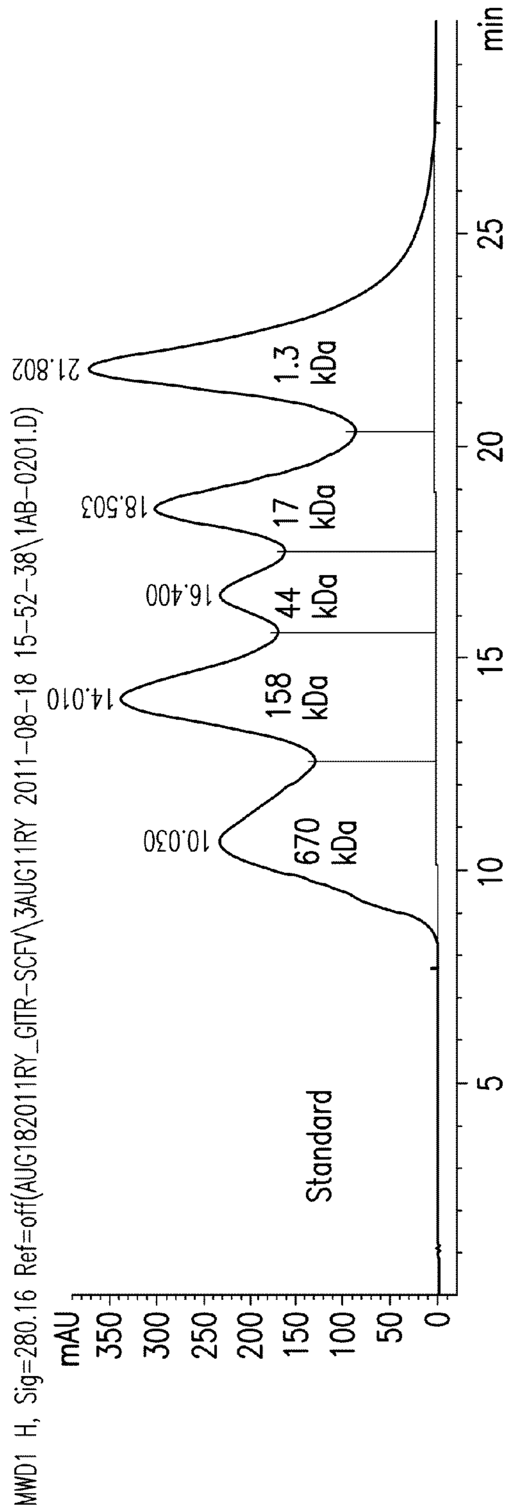
FIGS. 29A-B are graphs showing the elution profile of 912T from analytical SEC.
Figure 29B:
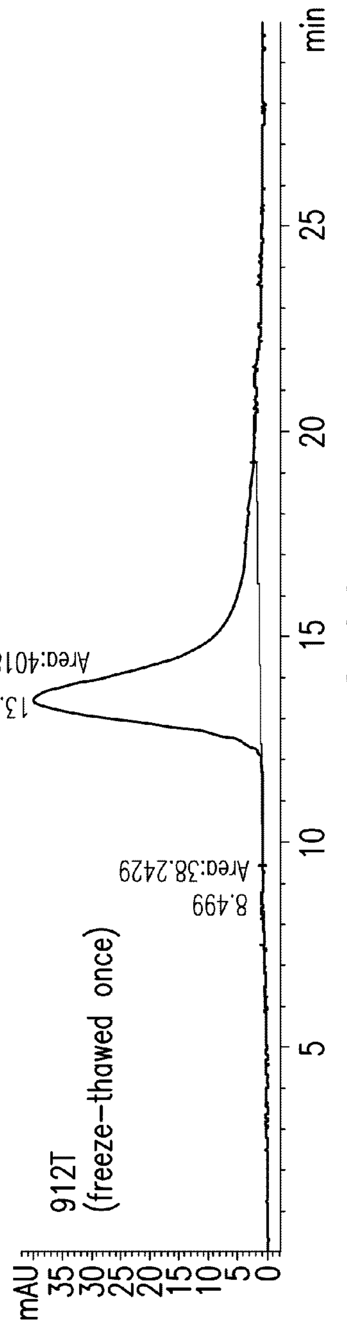

The molecules were produced, purified and characterized using the methods previously described in example 8 of this patent. They were well expressed and gel purity is shown in FIG. 27. In addition, both 911T and 912T were evaluated by analytical SEC and data are presented in FIG. 28 and FIG. 29, respectively. The Tm of 911T are 53.5° C., 60° C. and the Tm of 912T are 52.5° C. and 62° C. by DSF.

Figure 30:
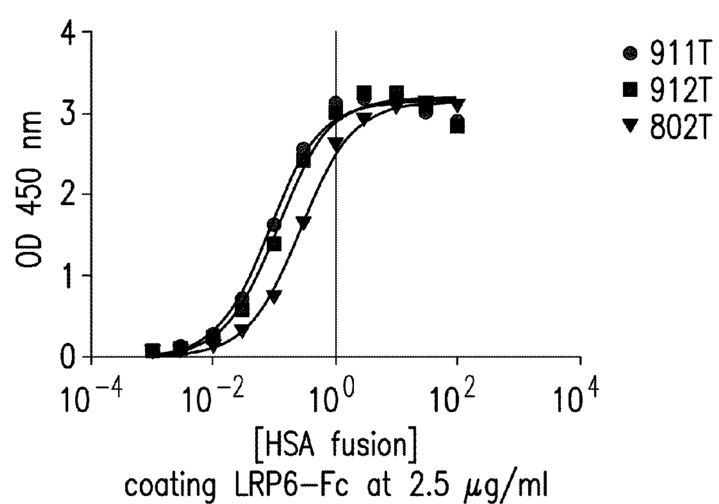
FIG. 30 is a graph showing the binding of anti-LRP6 scFv fusion molecules to LRP6 as determined by ELISA.

Binding EC50 of both 911T and 912T was determined by ELISA using the same methodology as described in example 10 of this patent. Results are presented in FIG. 30: the binding EC50 for 911T to LRP6-Fc (R&D Systems, catalog No: 1505-LR) was 0.084 nM, and the EC50 of 912T was 0.113 nM. These were all lower than the EC50 of 802T at 0.276 nM, likely reflecting the tetravalency of the Fc-fusion molecules.

Example 14

Assessment of in vitro Functional Activity of Anti-LRP6 Biparatopic Fc Based Fusion Molecules The anti-LRP6 biparatopic Fc based fusion molecules described in FIG. 25 were evaluated for their ability to inhibit both Wnt1 and Wnt3a-stimulated reporter gene activity using the same methodologies as described in example 4 above.

Figure 31A:
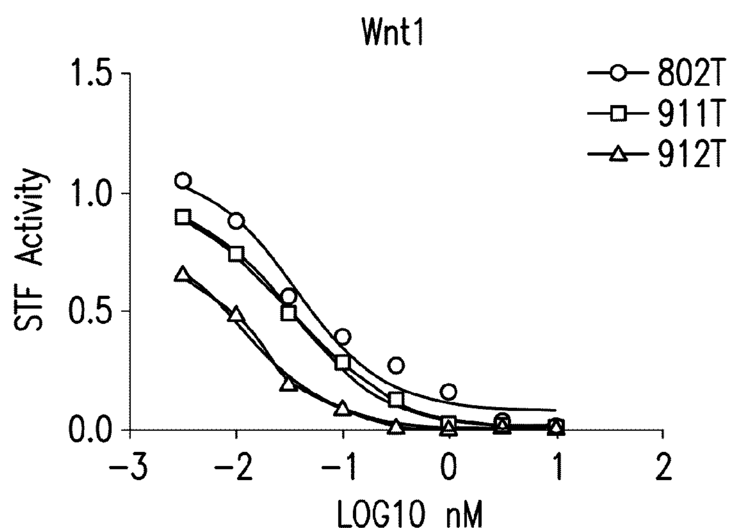
FIGS. 31A-B are graphs that show the activity of anti-LRP6 fusion molecules in Wnt1 and Wnt3a-stimulated HEK293 Wnt reporter gene assays.
Figure 31B:
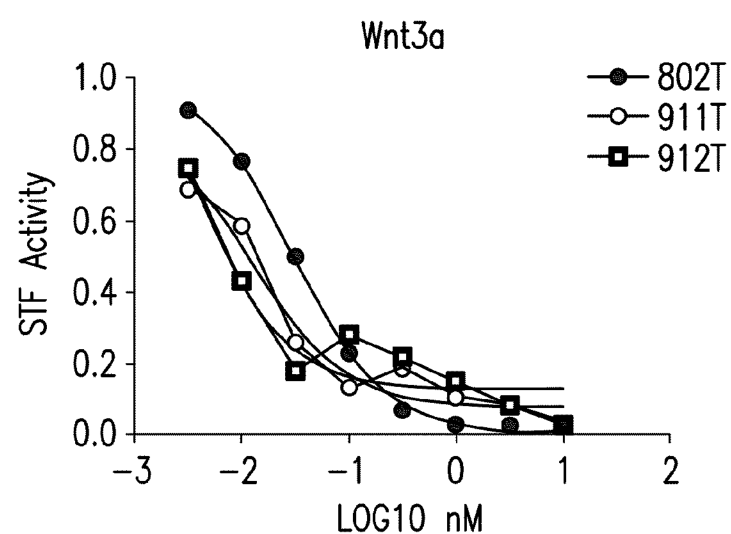

911T and 912T were tested using the transiently transfected cell format and all were found to be potent inhibitors of both Wnt1 and Wnt3a-mediated signaling (FIG. 31). In addition, all the molecules were found to be at least as potent as 802T, suggesting that the anti-LRP6 scFv moieties can retain their potency when fused to multiple half-life extending proteins.

---

SEQUENCE LISTING (336 sequences)

SEQ ID NO: 1 - protein, 5 aa, Homo sapiens
DYVIN

SEQ ID NO: 2 - protein, 17 aa, Homo sapiens
GISWSGVNTHYADSVKG

SEQ ID NO: 3 - protein, 15 aa, Homo sapiens
LGATANNIRYKFMDV

SEQ ID NO: 4 - protein, 10 aa, Homo sapiens
SGDSLRNKVY

SEQ ID NO: 5 - protein, 6 aa, Homo sapiens
KNNRPS

SEQ ID NO: 6 - protein, 10 aa, Homo sapiens
QSYDGQKSLV

SEQ ID NO: 7 - protein, 7 aa, Homo sapiens
GFTFSDY

SEQ ID NO: 8 - protein, 6 aa, Homo sapiens
SWSGVN

SEQ ID NO: 9 - protein, 15 aa, Homo sapiens
LGATANNIRYKFMDV

SEQ ID NO: 10 - protein, 6 aa, Homo sapiens
DSLRNK

SEQ ID NO: 11 - protein, 2 aa, Homo sapiens
KN

SEQ ID NO: 12 - protein, 7 aa, Homo sapiens
YDGQKSL

SEQ ID NO: 13 - protein, 105 aa, Homo sapiens
DIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVL

SEQ ID NO: 14 - protein, 124 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSS

SEQ ID NO: 15 - DNA, 315 bp, Homo sapiens
gatatcgaactgacccagccgccttcagtgagcgttgcaccaggtcagaccgcgcgtatctcgtgtagcggcgattctcttcgtaataaggtttattggtaccagcagaaacccgggcaggcgccagttcttgtgatttataagaataatcgtccctcaggcatcccggaacgctttagcggatccaacagcggcaacaccgcgaccctgaccattagcggcactcaggcggaagacgaagcggattattattgccagtcttatgatggtcagaagtctcttgtgtttggcggcggcacgaagttaaccgtccta

SEQ ID NO: 16 - DNA, 372 bp, Homo sapiens
caggtgcaattggtggaaagcggcggcggcctggtgcaaccgggcggcagcctgcgtctgagctgcgcggcctccggatttaccttttctgattatgttattaattgggtgcgccaagcccctgggaagggtctcgagtgggtgagcggtatttcttggtctggtgttaatactcattatgctgattctgttaagggtcgttttaccatttcacgtgataattcgaaaaacaccctgtatctgcaaatgaacagcctgcgtgcggaagatacggccgtgtattattgcgcgcgtcttggtgctactgctaataatattcgttataagtttatggatgtttggggccaaggcaccctggtgacggttagctca

SEQ ID NO: 17 - protein, 211 aa, Homo sapiens
DIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 18 - protein, 454 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - DNA, 633 bp, Homo sapiens
gatatcgaactgacccagccgccttcagtgagcgttgcaccaggtcagaccgcgcgtatctcgtgtagcggcgattctcttcgtaataaggtttattggtaccagcagaaacccgggcaggcgccagttcttgtgatttataagaataatcgtccctcaggcatcccggaacgctttagcggatccaacagcggcaacaccgcgaccctgaccattagcggcactcaggcggaagacgaagcggattattattgccagtcttatgatggtcagaagtctcttgtgtttggcggcggcacgaagttaaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 20 - DNA, 1362 bp, Homo sapiens
caggtgcaattggtggaaagcggcggcggcctggtgcaaccgggcggcagcctgcgtctgagctgcgcggcctccggatttaccttttctgattatgttattaattgggtgcgccaagcccctgggaagggtctcgagtgggtgagcggtatttcttggtctggtgttaatactcattatgctgattctgttaagggtcgttttaccatttcacgtgataattcgaaaaacaccctgtatctgcaaatgaacagcctgcgtgcggaagatacggccgtgtattattgcgcgcgtcttggtgctactgctaataatattcgttataagtttatggatgtttggggccaaggcaccctggtgacggttagctcagcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagcagcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 21 - protein, 5 aa, Homo sapiens
VNGMH

SEQ ID NO: 22 - protein, 16 aa, Homo sapiens
VIDGMGHTYYADSVKG

SEQ ID NO: 23 - protein, 11 aa, Homo sapiens
YDYIKYGAFDP

SEQ ID NO: 24 - protein, 11 aa, Homo sapiens
SGDNIGSKYVH

SEQ ID NO: 25 - protein, 7 aa, Homo sapiens
GDSNRPS

SEQ ID NO: 26 - protein, 10 aa, Homo sapiens
TRTSTPISGV

SEQ ID NO: 27 - protein, 7 aa, Homo sapiens
GFTFSVN

SEQ ID NO: 28 - protein, 5 aa, Homo sapiens
DGMGH

SEQ ID NO: 29 - protein, 11 aa, Homo sapiens
YDYIKYGAFDP

SEQ ID NO: 30 - protein, 7 aa, Homo sapiens
DNIGSKY

SEQ ID NO: 31 - protein, 3 aa, Homo sapiens
GDS

SEQ ID NO: 32 - protein, 7 aa, Homo sapiens
TSTPISG

SEQ ID NO: 33 - protein, 107 aa, Homo sapiens
DIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVL

SEQ ID NO: 34 - protein, 119 aa, Homo sapiens
QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSS

SEQ ID NO: 35 - protein, 107 aa, Homo sapiens
SYELTQPPSVSVSPGQTASITCSGDNIGSKYVHWYQQKPGQSPVLVIYGDSNRPSGIPERFSGSNSGNTATLTISGTQAMDEADYYCTRTSTPISGVFGGGTKLTVL

SEQ ID NO: 36 - protein, 119 aa, Homo sapiens
EVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSS

SEQ ID NO: 37 - DNA, 321 bp, Homo sapiens
gatatcgaactgacccagccgccttcagtgagcgttgcaccaggtcagaccgcgcgtatctcgtgtagcggcgataatattggttctaagtatgttcattggtaccagcagaaacccgggcaggcgccagttcttgtgatttatggtgattctaatcgtccctcaggcatcccggaacgctttagcggatccaacagcggcaacaccgcgaccctgaccattagcggcactcaggcggaagacgaagcggattattattgcactcgtacttctactcctatttctggtgtgtttggcggcggcacgaagttaaccgttctt

SEQ ID NO: 38 - DNA, 357 bp, Homo sapiens
caggtgcaattggtggaaagcggcggcggcctggtgcaaccgggcggcagcctgcgtctgagctgcgcggcctccggatttaccttttctgttaatggtatgcattgggtgcgccaagcccctgggaagggtctcgagtgggtgagcgttattgatggtatgggtcatacttattatgctgattctgttaagggtcgttttaccatttcacgtgataattcgaaaaacaccctgtatctgcaaatgaacagcctgcgtgcggaagatacggccgtgtattattgcgcgcgttatgattatattaagtatggtgcttttgatccttggggccaaggcaccctggtgacggttagctca

SEQ ID NO: 39 - protein, 212 aa, Homo sapiens
DIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEA

SEQ ID NO: 40 - protein, 221 aa, Homo sapiens
QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 41 - DNA, 636 bp, Homo sapiens
gatatcgaactgacccagccgccttcagtgagcgttgcaccaggtcagaccgcgcgtatctcgtgtagcggcgataatattggttctaagtatgttcattggtaccagcagaaacccgggcaggcgccagttcttgtgatttatggtgattctaatcgtccctcaggcatcccggaacgctttagcggatccaacagcggcaacaccgcgaccctgaccattagcggcactcaggcggaagacgaagcggattattattgcactcgtacttctactcctatttctggtgtgtttggcggcggcacgaagttaaccgttcttggccagccgaaagccgcaccgagtgtgacgctgtttccgccgagcagcgaagaattgcaggcgaacaaagcgaccctggtgtgcctgattagcgacttttatccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaggggagcaccgtggaaaaaaccgttgcgccgactgaggcc

SEQ ID NO: 42 - DNA, 663 bp, Homo sapiens
caggtgcaattggtggaaagcggcggcggcctggtgcaaccgggcggcagcctgcgtctgagctgcgcggcctccggatttaccttttctgttaatggtatgcattgggtgcgccaagcccctgggaagggtctcgagtgggtgagcgttattgatggtatgggtcatacttattatgctgattctgttaagggtcgttttaccatttcacgtgataattcgaaaaacaccctgtatctgcaaatgaacagcctgcgtgcggaagatacggccgtgtattattgcgcgcgttatgattatattaagtatggtgcttttgatccttggggccaaggcaccctggtgacggttagctcagcgtcgaccaaaggtccaagcgtgtttccgctggctccgagcagcaaaagcaccagcggcggcacggctgccctgggctgcctggttaaagattatttcccggaaccagtcaccgtgagctggaacagcggggcgctgaccagcggcgtgcatacctttccggcggtgctgcaaagcagcggcctgtatagcctgagcagcgttgtgaccgtgccgagcagcagcttaggcactcagacctatatttgcaacgtgaaccataaaccgagcaacaccaaagtggataaaaaagtggaaccgaaaagc

SEQ ID NO: 43 - protein, 107 aa, Homo sapiens
SYELTQPLSVSVALGQTARITCGGDNIGSKYVHWYQQKPGQAPVLVIYGDSNRPSGIPERFSGSNSGNTATLTISRAQAGDEADYYCTRTSTPISGVFGGGTKLTVL

SEQ ID NO: 44 - protein, 119 aa, Homo sapiens
EVQLLESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSS

SEQ ID NO: 45 - DNA, 321 bp, Homo sapiens
agctatgaactgacccagccgctgtctgtgagcgtggcgctgggccagaccgcgcgtattacctgcggtggcgataacattggcagcaaatatgtgcattggtatcagcagaaaccgggccaggcgccggtgctggtgatttatggcgatagcaaccgtccgagcggcattccggaacgttttagcggcagcaacagcggcaacaccgcgaccctgaccatttctcgcgcgcaggcgggtgatgaagcggattattattgcacccgtaccagcaccccgattagcggcgtgtttggcggcggtacgaagttaaccgttctt

SEQ ID NO: 46 - DNA, 357 bp, Homo sapiens
gaggtgcaattgctggaaagcggcggcggcctggtgcaaccgggcggcagcctgcgtctgagctgcgcggcctccggatttaccttttctgttaatggtatgcattgggtgcgccaagcccctgggaagggtctcgagtgggtgagcgttattgatggtatgggtcatacttattatgctgattctgttaagggtcgttttaccatttcacgtgataattcgaaaaacaccctgtatctgcaaatgaacagcctgcgtgcggaagatacggccgtgtattattgcgcgcgttatgattatattaagtatggtgcttttgatccttggggccaaggcaccctggtgacggttagctca

SEQ ID NO: 47 - protein, 5 aa, Homo sapiens
DYAIH

SEQ ID NO: 48 - protein, 17 aa, Homo sapiens
GISYSGSSTHYADSVKG

SEQ ID NO: 49 - protein, 14 aa, Homo sapiens
GSHGNIMAKRYFDF

SEQ ID NO: 50 - protein, 11 aa, Homo sapiens
SGDNIRKKYVY

SEQ ID NO: 51 - protein, 7 aa, Homo sapiens
EDSKRPS

SEQ ID NO: 52 - protein, 11 aa, Homo sapiens
STADSGINNGV

SEQ ID NO: 53 - protein, 7 aa, Homo sapiens
GFTFSDY

SEQ ID NO: 54 - protein, 6 aa, Homo sapiens
SYSGSS

SEQ ID NO: 55 - protein, 14 aa, Homo sapiens
GSHGNIMAKRYFDF

SEQ ID NO: 56 - protein, 7 aa, Homo sapiens
DNIRKKY

SEQ ID NO: 57 - protein, 3 aa, Homo sapiens
EDS

SEQ ID NO: 58 - protein, 8 aa, Homo sapiens
ADSGINNG

SEQ ID NO: 59 - protein, 108 aa, Homo sapiens
DIELTQPPSVSVAPGQTARISCSGDNIRKKYVYWYQQKPGQAPVLVIYEDSKRPSGIPERFSGSNSGNTATLTISGTQAEDEADYYCSTADSGINNGVFGGGTKLTVL

SEQ ID NO: 60 - protein, 123 aa, Homo sapiens
QVQLVESGGGLVQPGGSLRLSCAASGFTFSDYAIHWVRQAPGKGLEWVSGISYSGSSTHYADSVKGRFTISRDNSKNTLYLQMNSLRAEDTAVYYCARGSHGNIMAKRYFDFWGQGTLVTVSS

SEQ ID NO: 61 - protein, 108 aa, Homo sapiens
SYELTQPPSVSVSPGQTASITCSGDNIRKKYVYWYQQKPGQSPVLVIYEDSKRPSGIPERFSGSNSGNTATLTISGTQAMDEADYYCSTADSGINNGVFGGGTKLTVL

SEQ ID NO: 62 - protein, 123 aa, Homo sapiens
EVQLVESGGGLVQPGGSLRLSCAASGFTFSDYAIHWVRQAPGKGLEWVSGISYSGSSTHYADSVKGRFTISRDNSKNTLYLQMNSLRAEDTAVYYCARGSHGNIMAKRYFDFWGQGTLVTVSS

SEQ ID NO: 63 - DNA, 324 bp, Homo sapiens
gatatcgaactgacccagccgccttcagtgagcgttgcaccaggtcagaccgcgcgtatctcgtgtagcggcgataatattcgtaagaagtatgtttattggtaccagcagaaacccgggcaggcgccagttcttgtgatttatgaggattctaagcgtccctcaggcatcccggaacgctttagcggatccaacagcggcaacaccgcgaccctgaccattagcggcactcaggcggaagacgaagcggattattattgctctactgctgattctggtattaataatggtgtgtttggcggcggcacgaagttaaccgttctt

SEQ ID NO: 64 - DNA, 369 bp, Homo sapiens
caggtgcaattggtggaaagcggcggcggcctggtgcaaccgggcggcagcctgcgtctgagctgcgcggcctccggatttaccttttctgattatgctattcattgggtgcgccaagcccctgggaagggtctcgagtgggtgagcggtatctcttattctggtagctctacccattatgcggatagcgtgaaaggccgttttaccatttcacgtgataattcgaaaaacaccctgtatctgcaaatgaacagcctgcgtgcggaagatacggccgtgtattattgcgcgcgtggttctcatggtaatattatggctaagcgttattttgatttttggggccaaggcaccctggtgacggttagctca

SEQ ID NO: 65 - protein, 214 aa, Homo sapiens
DIELTQPPSVSVAPGQTARISCSGDNIRKKYVYWYQQKPGQAPVLVIYEDSKRPSGIPERFSGSNSGNTATLTISGTQAEDEADYYCSTADSGINNGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 66 - protein, 453 aa, Homo sapiens
QVQLVESGGGLVQPGGSLRLSCAASGFTFSDYAIHWVRQAPGKGLEWVSGISYSGSSTHYADSVKGRFTISRDNSKNTLYLQMNSLRAEDTAVYYCARGSHGNIMAKRYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - DNA, 642 bp, Homo sapiens
gatatcgaactgacccagccgccttcagtgagcgttgcaccaggtcagaccgcgcgtatctcgtgtagcggcgataatattcgtaagaagtatgtttattggtaccagcagaaacccgggcaggcgccagttcttgtgatttatgaggattctaagcgtccctcaggcatcccggaacgctttagcggatccaacagcggcaacaccgcgaccctgaccattagcggcactcaggcggaagacgaagcggattattattgctctactgctgattctggtattaataatggtgtgtttggcggcggcacgaagttaaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 68 - DNA, 1359 bp, Homo sapiens
caggtgcaattggtggaaagcggcggcggcctggtgcaaccgggcggcagcctgcgtctgagctgcgcggcctccggatttaccttttctgattatgctattcattgggtgcgccaagcccctgggaagggtctcgagtgggtgagcggtatctcttattctggtagctctacccattatgcggatagcgtgaaaggccgttttaccatttcacgtgataattcgaaaaacaccctgtatctgcaaatgaacagcctgcgtgcggaagatacggccgtgtattattgcgcgcgtggttctcatggtaatattatggccaagcgttattttgatttttggggccaaggcaccctggtgacggttagctcagcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagcagcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 69 - protein, 7 aa, Homo sapiens
NRGGGVG

SEQ ID NO: 70 - protein, 16 aa, Homo sapiens
WIDWDDDKSYSTSLKT

SEQ ID NO: 71 - protein, 9 aa, Homo sapiens
MHLPLVFDS

SEQ ID NO: 72 - protein, 12 aa, Homo sapiens
RASQFIGSRYLA

SEQ ID NO: 73 - protein, 7 aa, Homo sapiens
GASNRAT

SEQ ID NO: 74 - protein, 9 aa, Homo sapiens
QQYYDYPQT

SEQ ID NO: 75 - protein, 9 aa, Homo sapiens
GFSLSNRGG

SEQ ID NO: 76 - protein, 5 aa, Homo sapiens
DWDDD

SEQ ID NO: 77 - protein, 9 aa, Homo sapiens
MHLPLVFDS

SEQ ID NO: 78 - protein, 8 aa, Homo sapiens
SQFIGSRY

SEQ ID NO: 79 - protein, 3 aa, Homo sapiens
GAS

SEQ ID NO: 80 - protein, 6 aa, Homo sapiens
YYDYPQ

SEQ ID NO: 81 - protein, 108 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIK

SEQ ID NO: 82 - protein, 119 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 83 - DNA, 324 bp, Homo sapiens
gatatcgtgctgacccagagcccggcgaccctgagcctgtctccgggcgaacgtgcgaccctgagctgcagagcgagccagtttattggttctcgttatctggcttggtaccagcagaaaccaggtcaagcaccgcgtctattaatttatggtgcttctaatcgtgcaactggggtcccggcgcgttttagcggctctggatccggcacggattttaccctgaccattagcagcctggaacctgaagactttgcgacttattattgccagcagtattatgattatcctcagacctttggccagggtacgaaagttgaaattaaa

SEQ ID NO: 84 - DNA, 357 bp, Homo sapiens
caggtgcaattgaaagaaagcggcccggccctggtgaaaccgacccaaaccctgaccctgacctgtaccttttccggatttagcctgtctaatcgtggtggtggtgtgggttggattcgccagccgcctgggaaagccctcgagtggctggcttggatcgattgggatgatgataagtcttatagcaccagcctgaaaacgcgtctgaccattagcaaagatacttcgaaaaatcaggtggtgctgactatgaccaacatggacccggtggatacggccacctattattgcgcgcgtatgcatcttcctcttgtttttgattcttggggccaaggcaccctggtgacggttagctca

SEQ ID NO: 85 - protein, 215 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 449 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - DNA, 645 bp, Homo sapiens
gatatcgtgctgacccagagcccggcgaccctgagcctgtctccgggcgaacgtgcgaccctgagctgcagagcgagccagtttattggttctcgttatctggcttggtaccagcagaaaccaggtcaagcaccgcgtctattaatttatggtgcttctaatcgtgcaactggggtcccggcgcgttttagcggctctggatccggcacggattttaccctgaccattagcagcctggaacctgaagactttgcgacttattattgccagcagtattatgattatcctcagacctttggccagggtacgaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 88 - DNA, 1347 bp, Homo sapiens
caggtgcaattgaaagaaagcggcccggccctggtgaaaccgacccaaaccctgaccctgacctgtaccttttccggatttagcctgtctaatcgtggtggtggtgtgggttggattcgccagccgcctgggaaagccctcgagtggctggcttggatcgattgggatgatgataagtcttatagcaccagcctgaaaacgcgtctgaccattagcaaagatacttcgaaaaatcaggtggtgctgactatgaccaacatggacccggtggatacggccacctattattgcgcgcgtatgcatcttcctcttgtttttgattcttggggccaaggcaccctggtgacggttagctcagcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagcagcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 89 - protein, 119 aa, Homo sapiens
QVTLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 90 - protein, 108 aa, Homo sapiens
EIVLTQSPATLSLSPGERATLSCRASQFIGSRYLAWYQQKPGQAPRLLIYGASNRATGIPARFSGSGSGTDFTLTISSLEPEDFAVYYCQQYYDYPQTFGQGTKVEIK

SEQ ID NO: 91 - DNA, 357 bp, Homo sapiens
caggtcacactgaaagagtccggccctgccctggtcaaacccacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatcagcaaggacaccagcaagaaccaggtggtgctgaccatgaccaacatggaccccgtggacaccgccacctactactgcgcccggatgcatctgcccctggtgttcgatagctggggccagggcaccctggtcaccgtcagctca

SEQ ID NO: 92 - DNA, 324 bp, Homo sapiens
gaaatcgtgctgacccagagccccgccaccctgtctctgagccctggcgagagagccaccctgagctgccgggccagccagttcatcggcagcagatacctggcttggtatcagcagaagcccggccaggcccccagactgctgatctacggcgccagcaaccgggccaccggcatccctgccagattttctggcagcggcagcggcaccgacttcaccctgaccatcagcagcctggaacccgaggacttcgccgtgtactactgccagcagtactacgactacccccagaccttcggccagggcaccaaggtggaaatcaag

SEQ ID NO: 93 - protein, 7 aa, Homo sapiens
NRGGGVG

SEQ ID NO: 94 - protein, 16 aa, Homo sapiens
WIDWDDDKSYSTSLKT

SEQ ID NO: 95 - protein, 9 aa, Homo sapiens
MHLPLVFDS

SEQ ID NO: 96 - protein, 12 aa, Homo sapiens
RASQFIGSRYLA

SEQ ID NO: 97 - protein, 7 aa, Homo sapiens
GASNRAT

SEQ ID NO: 98 - protein, 9 aa, Homo sapiens
QQYWSIPIT

SEQ ID NO: 99 - protein, 9 aa, Homo sapiens
MHLPLVFDS

SEQ ID NO: 100 - protein, 5 aa, Homo sapiens
DWDDD

SEQ ID NO: 101 - protein, 9 aa, Homo sapiens
MHLPLVFDS

SEQ ID NO: 102 - protein, 8 aa, Homo sapiens
SQFIGSRY

SEQ ID NO: 103 - protein, 3 aa, Homo sapiens
GAS

SEQ ID NO: 104 - protein, 6 aa, Homo sapiens
YWSIPI

SEQ ID NO: 105 - protein, 108 aa, Homo sapiens
DIVLTQSPATLSLSPGERATLSCRASQFIGSRYLAWYQQKPGQAPRLLIYGASNRATGVPARFSGSGSGTDFTLTISSLEPEDFAVYYCQQYWSIPITFGQGTKVEIK

SEQ ID NO: 106 - protein, 119 aa, Homo sapiens; identical to SEQ ID NO: 82

SEQ ID NO: 107 - protein, 108 aa, Homo sapiens
EIVLTQSPATLSLSPGERATLSCRASQFIGSRYLAWYQQKPGQAPRLLIYGASNRATGIPARFSGSGSGTDFTLTISSLEPEDFAVYYCQQYWSIPITFGQGTKVEIK

SEQ ID NO: 108 - protein, 119 aa, Homo sapiens; identical to SEQ ID NO: 89

SEQ ID NO: 109 - DNA, 324 bp, Homo sapiens
gatatcgtgctgacccagagcccggcgaccctgagcctgtctccgggcgaacgtgcgaccctgagctgcagagcgagccagtttattggttctcgttatctggcttggtaccagcagaaaccaggtcaagcaccgcgtctattaatttatggtgcttctaatcgtgcaactggggtcccggcgcgttttagcggctctggatccggcacggattttaccctgaccattagcagcctggaacctgaagactttgcggtgtattattgccagcagtattggtctattcctattacctttggccagggtacgaaagttgaaattaaa

SEQ ID NO: 110 - DNA, 357 bp, Homo sapiens; identical to SEQ ID NO: 84

SEQ ID NO: 111 - protein, 215 aa, Homo sapiens
DIVLTQSPATLSLSPGERATLSCRASQFIGSRYLAWYQQKPGQAPRLLIYGASNRATGVPARFSGSGSGTDFTLTISSLEPEDFAVYYCQQYWSIPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEA

SEQ ID NO: 112 - protein, 221 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 113 - DNA, 645 bp, Homo sapiens
gatatcgtgctgacccagagcccggcgaccctgagcctgtctccgggcgaacgtgcgaccctgagctgcagagcgagccagtttattggttctcgttatctggcttggtaccagcagaaaccaggtcaagcaccgcgtctattaatttatggtgcttctaatcgtgcaactggggtcccggcgcgttttagcggctctggatccggcacggattttaccctgaccattagcagcctggaacctgaagactttgcggtgtattattgccagcagtattggtctattcctattacctttggccagggtacgaaagttgaaattaaacgtacggtggctgctccgagcgtgtttatttttccgccgagcgatgaacaactgaaaagcggcacggcgagcgtggtgtgcctgctgaacaacttttatccgcgtgaagcgaaagttcagtggaaagtagacaacgcgctgcaaagcggcaacagccaggaaagcgtgaccgaacaggatagcaaagatagcacctattctctgagcagcaccctgaccctgagcaaagcggattatgaaaaacataaagtgtatgcgtgcgaagtgacccatcaaggtctgagcagcccggtgactaaatcttttaatcgtggcgaggcc

SEQ ID NO: 114 - DNA, 663 bp, Homo sapiens
caggtgcaattgaaagaaagcggcccggccctggtgaaaccgacccaaaccctgaccctgacctgtaccttttccggatttagcctgtctaatcgtggtggtggtgtgggttggattcgccagccgcctgggaaagccctcgagtggctggcttggatcgattgggatgatgataagtcttatagcaccagcctgaaaacgcgtctgaccattagcaaagatacttcgaaaaatcaggtggtgctgactatgaccaacatggacccggtggatacggccacctattattgcgcgcgtatgcatcttcctcttgtttttgattcttggggccaaggcaccctggtgacggttagctcagcgtcgaccaaaggtccaagcgtgtttccgctggctccgagcagcaaaagcaccagcggcggcacggctgccctgggctgcctggttaaagattatttcccggaaccagtcaccgtgagctggaacagcggggcgctgaccagcggcgtgcatacctttccggcggtgctgcaaagcagcggcctgtatagcctgagcagcgttgtgaccgtgccgagcagcagcttaggcactcagacctatatttgcaacgtgaaccataaaccgagcaacaccaaagtggataaaaaagtggaaccgaaaagc

SEQ ID NO: 115 - protein, 5 aa, Homo sapiens
SYGMS

SEQ ID NO: 116 - protein, 17 aa, Homo sapiens
NISNDGHYTYYADSVKG

SEQ ID NO: 117 - protein, 11 aa, Homo sapiens
FQASYLDIMDY

SEQ ID NO: 118 - protein, 11 aa, Homo sapiens
SGDNIGSKYVH

SEQ ID NO: 119 - protein, 7 aa, Homo sapiens
NDSNRPS

SEQ ID NO: 120 - protein, 10 aa, Homo sapiens
QAWGDNGTRV

SEQ ID NO: 121 - protein, 7 aa, Homo sapiens
GFTFSSY

SEQ ID NO: 122 - protein, 6 aa, Homo sapiens
SNDGHY

SEQ ID NO: 123 - protein, 11 aa, Homo sapiens
FQASYLDIMDY

SEQ ID NO: 124 - protein, 7 aa, Homo sapiens
DNIGSKY

SEQ ID NO: 125 - protein, 3 aa, Homo sapiens
NDS

SEQ ID NO: 126 - protein, 7 aa, Homo sapiens
WGDNGTR

SEQ ID NO: 127 - protein, 107 aa, Homo sapiens
DIELTQPPSVSVAPGQSITISCSGDNIGSKYVHWYQQKPGQAPVLVIYNDSNRPSGIPERFSGSNSGNTATLTISGTQAEDEADYYCQAWGDNGTRVFGGGTKLTVL

SEQ ID NO: 128 - protein, 120 aa, Homo sapiens
QVQLVESGGGLVQPGGSLRLSCAASGFTFSSYGMSWVRQAPGKGLEWVSNISNDGHYTYYADSVKGRFTISRDNSKNTLYLQMNSLRAEDTAVYYCARFQASYLDIMDYWGQGTLVTVSS

SEQ ID NO: 129 - protein, 107 aa, Homo sapiens
SYELTQPPSVSVSPGQTASITCSGDNIGSKYVHWYQQKPGQSPVLVIYNDSNRPSGIPERFSGSNSGNTATLTISGTQAMDEADYYCQAWGDNGTRVFGGGTKLTVL

SEQ ID NO: 130 - protein, 120 aa, Homo sapiens
EVQLVESGGGLVQPGGSLRLSCAASGFTFSSYGMSWVRQAPGKGLEWVSNISNDGHYTYYADSVKGRFTISRDNSKNTLYLQMNSLRAEDTAVYYCARFQASYLDIMDYWGQGTLVTVSS

SEQ ID NO: 131 - DNA, 321 bp, Homo sapiens
gatatcgaactgacccagccgccttcagtgagcgttgcaccaggtcagagcattaccatctcgtgtagcggcgataatattggttctaagtatgttcattggtaccagcagaaacccgggcaggcgccagttcttgtgatttataatgattctaatcgtccctcaggcatcccggaacgctttagcggatccaacagcggcaacaccgcgaccctgaccattagcggcactcaggcggaagacgaagcggattattattgccaggcttggggtgataatggtactcgtgtgtttggcggcggcacgaagttaaccgttctt

SEQ ID NO: 132 - DNA, 360 bp, Homo sapiens
caggtgcaattggtggaaagcggcggcggcctggtgcaaccgggcggcagcctgcgtctgagctgcgcggcctccggatttaccttttcttcttatggtatgtcttgggtgcgccaagcccctgggaagggtctcgagtgggtgagcaatatttctaatgatggtcattatacttattatgctgattctgttaagggtcgttttaccatttcacgtgataattcgaaaaacaccctgtatctgcaaatgaacagcctgcgtgcggaagatacggccgtgtattattgcgcgcgttttcaggcttcttatcttgatattatggattattggggccaaggcaccctggtgacggttagctca

SEQ ID NO: 133 - protein, 212 aa, Homo sapiens
DIELTQPPSVSVAPGQSITISCSGDNIGSKYVHWYQQKPGQAPVLVIYNDSNRPSGIPERFSGSNSGNTATLTISGTQAEDEADYYCQAWGDNGTRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEA

SEQ ID NO: 134 - protein, 222 aa, Homo sapiens
QVQLVESGGGLVQPGGSLRLSCAASGFTFSSYGMSWVRQAPGKGLEWVSNISNDGHYTYYADSVKGRFTISRDNSKNTLYLQMNSLRAEDTAVYYCARFQASYLDIMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 135 - DNA, 636 bp, Homo sapiens
gatatcgaactgacccagccgccttcagtgagcgttgcaccaggtcagagcattaccatctcgtgtagcggcgataatattggttctaagtatgttcattggtaccagcagaaacccgggcaggcgccagttcttgtgatttataatgattctaatcgtccctcaggcatcccggaacgctttagcggatccaacagcggcaacaccgcgaccctgaccattagcggcactcaggcggaagacgaagcggattattattgccaggcttggggtgataatggtactcgtgtgtttggcggcggcacgaagttaaccgttcttggccagccgaaagccgcaccgagtgtgacgctgtttccgccgagcagcgaagaattgcaggcgaacaaagcgaccctggtgtgcctgattagcgacttttatccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaggggagcaccgtggaaaaaaccgttgcgccgactgaggcc

SEQ ID NO: 136 - DNA, 666 bp, Homo sapiens
caggtgcaattggtggaaagcggcggcggcctggtgcaaccgggcggcagcctgcgtctgagctgcgcggcctccggatttaccttttcttcttatggtatgtcttgggtgcgccaagcccctgggaagggtctcgagtgggtgagcaatatttctaatgatggtcattatacttattatgctgattctgttaagggtcgttttaccatttcacgtgataattcgaaaaacaccctgtatctgcaaatgaacagcctgcgtgcggaagatacggccgtgtattattgcgcgcgttttcaggcttcttatcttgatattatggattattggggccaaggcaccctggtgacggttagctcagcgtcgaccaaaggtccaagcgtgtttccgctggctccgagcagcaaaagcaccagcggcggcacggctgccctgggctgcctggttaaagattatttcccggaaccagtcaccgtgagctggaacagcggggcgctgaccagcggcgtgcatacctttccggcggtgctgcaaagcagcggcctgtatagcctgagcagcgttgtgaccgtgccgagcagcagcttaggcactcagacctatatttgcaacgtgaaccataaaccgagcaacaccaaagtggataaaaaagtggaaccgaaaagc

SEQ ID NO: 137 - protein, 107 aa, Homo sapiens
SYELTQPLSVSVALGQTARITCGGDNIGSKYVHWYQQKPGQAPVLVIYNDSNRPSGIPERFSGSNSGNTATLTISRAQAGDEADYYCQAWGDNGTRVFGGGTKLTVL

SEQ ID NO: 138 - protein, 120 aa, Homo sapiens
EVQLLESGGGLVQPGGSLRLSCAASGFTFSSYGMSWVRQAPGKGLEWVSNISNDGHYTYYADSVKGRFTISRDNSKNTLYLQMNSLRAEDTAVYYCARFQASYLDIMDYWGQGTLVTVSS

SEQ ID NO: 139 - DNA, 321 bp, Homo sapiens
agctatgaactgacccagccgctgagtgttagcgttgcgctgggtcagaccgcgcgtattacctgcggcggtgataacattggcagcaaatatgtgcattggtatcagcagaaaccgggccaggcgccggtgctggtgatttataacgatagcaaccgtccgagcggcattccggaacgttttagcggcagcaacagcggcaataccgcgaccctgaccattagccgtgcgcaggcgggtgatgaagcggattattattgccaggcgtggggcgataatggtacgcgtgtgtttggcggtggtacgaagttaaccgttctt

SEQ ID NO: 140 - DNA, 360 bp, Homo sapiens
gaggtgcaattgctggaaagcggcggcggcctggtgcaaccgggcggcagcctgcgtctgagctgcgcggcctccggatttaccttttcttcttatggtatgtcttgggtgcgccaagcccctgggaagggtctcgagtgggtgagcaatatttctaatgatggtcattatacttattatgctgattctgttaagggtcgttttaccatttcacgtgataattcgaaaaacaccctgtatctgcaaatgaacagcctgcgtgcggaagatacggccgtgtattattgcgcgcgttttcaggcttcttatcttgatattatggattattggggccaaggcaccctggtgacggttagctca

SEQ ID NO: 141 - DNA, 726 bp, Homo sapiens
gatatcgttctgacccagagtccggcaaccctgagcctgagtccgggtgaacgtgccaccctgagctgtcgtgcaagccagtttattggtagccgttatctggcatggtatcagcagaaaccgggtcaggcaccgcgtctgctgatttatggtgcaagcaatcgtgcaaccggtgttccggcacgttttagcggtagcggtagtggcaccgattttaccctgaccattagcagcctggaaccggaagattttgcaacctattattgccagcagtattatgattatccgcagacctttggtcagggcaccaaggtggaaattaaaggtggtggtggtagcggtggtggtggctcaggtggtggcggtagtcaggttcaattgaaagaaagcggtccggcactggttaaaccgacccagaccctgaccctgacatgtacctttagcggttttagcctgagcaatcgtggtggtggtgttggttggattcgtcagcctccgggtaaagcactggaatggctggcatggattgattgggatgatgataaaagctatagcaccagcctgaaaacccgtctgaccattagtaaagataccagcaaaaatcaggtggttctgaccatgaccaatatggatccggttgataccgccacctattattgtgcacgtatgcatctgccgctggtttttgatagctggggtcagggtacactagttaccgttagcagc

SEQ ID NO: 142 - protein, 242 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 143 - DNA, 741 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagc

SEQ ID NO: 144 - protein, 247 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 145 - DNA, 726 bp, Homo sapiens
caggttcaattgaaagaaagcggtccggcactggttaaaccgacccagaccctgaccctgacatgtacctttagcggttttagcctgagcaatcgtggtggtggtgttggttggattcgtcagcctccgggtaaagcactggaatggctggcatggattgattgggatgatgataaaagctatagcaccagcctgaaaacccgtctgaccattagcaaagataccagcaaaaatcaggttgttctgaccatgaccaatatggatccggttgataccgcaacctattattgtgcacgtatgcatctgccgctggtttttgatagctggggtcagggtacactagttaccgttagcagcggtggtggtggtagcggtggtggcggttcaggtggtggtggcagtgatatcgttctgacccagagtccggcaaccctgagcctgagtccgggtgaacgtgccaccctgagctgtcgtgcaagccagtttattggtagccgttatctggcatggtatcagcagaaaccgggtcaggcaccgcgtctgctgatttatggtgcaagcaatcgtgcaaccggtgttccggcacgttttagcggtagcggtagtggcaccgattttaccctgaccattagtagcctggaaccggaagattttgccacctattattgccagcagtattatgattatccgcagacctttggtcagggcaccaaggtggaaattaaa

SEQ ID NO: 146 - protein, 242 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSGGGGSGGGGSGGGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIK

SEQ ID NO: 147 - DNA, 741 bp, Homo sapiens
caggttcaattgaaagaaagcggtccggcactggttaaaccgacccagaccctgaccctgacatgtacctttagcggttttagcctgagcaatcgtggtggtggtgttggttggattcgtcagcctccgggtaaagcactggaatggctggcatggattgattgggatgatgataaaagctatagcaccagcctgaaaacccgtctgaccattagcaaagataccagcaaaaatcaggttgttctgaccatgaccaatatggatccggttgataccgcaacctattattgtgcacgtatgcatctgccgctggtttttgatagctggggtcagggtacactagttaccgttagcagcggtggtggtggtagcggtggtggcggttcaggtggtggtggcagtggcggtggtggtagtgatatcgttctgacccagagtccggcaaccctgagcctgagtccgggtgaacgtgccaccctgagctgtcgtgcaagccagtttattggtagccgttatctggcatggtatcagcagaaaccgggtcaggcaccgcgtctgctgatttatggtgcaagcaatcgtgcaaccggtgttccggcacgttttagcggtagcggtagtggcaccgattttaccctgaccattagtagcctggaaccggaagattttgccacctattattgccagcagtattatgattatccgcagacctttggtcagggcaccaaggtggaaattaaa

SEQ ID NO: 148 - protein, 247 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSGGGGSGGGGSGGGGSGGGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIK

SEQ ID NO: 149 - DNA, 732 bp, Homo sapiens
gatatcgaactgacccagcctccgagcgttagcgttgcaccgggtcagaccgcacgtattagctgtagcggtgatagcctgcgtaataaagtttattggtatcagcagaaaccgggtcaggcaccggttctggttatttataaaaataatcgtccgagcggtattccggaacgttttagcggtagcaatagcggtaataccgcaaccctgaccattagcggcacccaggcagaagatgaagcagattattattgccagagctatgatggtcagaaaagcctggtttttggtggtggcaccaagcttaccgttctgggtggtggtggtagcggtggtggtggctcaggtggtggcggttctcaggttcaattggttgaaagtggtggtggtctggttcagcctggtggtagcctgcgtctgagctgtgcagcaagcggttttacctttagcgattatgtgattaattgggttcgccaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagc

SEQ ID NO: 150 - protein, 249 aa, Homo sapiens
DIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLGGGGSGGGGSGGGGSGGGGSQVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSS

SEQ ID NO: 151 - DNA, 747 bp, Homo sapiens
gatatcgaactgacccagcctccgagcgttagcgttgcaccgggtcagaccgcacgtattagctgtagcggtgatagcctgcgtaataaagtttattggtatcagcagaaaccgggtcaggcaccggttctggttatttataaaaataatcgtccgagcggtattccggaacgttttagcggtagcaatagcggtaataccgcaaccctgaccattagcggcacccaggcagaagatgaagcagattattattgccagagctatgatggtcagaaaagcctggtttttggtggtggcaccaagcttaccgttctgggtggtggtggtagcggtggtggtggctcaggtggtggcggttctggtggcggtggttcacaggttcaattggttgaaagtggtggtggtctggttcagcctggtggtagcctgcgtctgagctgtgcagcaagcggttttacctttagcgattatgtgattaattgggttcgccaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagc

SEQ ID NO: 152 - protein, 249 aa, Homo sapiens; identical to SEQ ID NO: 150

SEQ ID NO: 153 - DNA, 732 bp, Homo sapiens
caggttcaattggttgaaagcggtggtggtctggttcagcctggtggtagcctgcgtctgagctgtgcagcaagcggttttacctttagcgattatgtgattaattgggttcgtcaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggtggtagcggtggtggcggatctggtggcggtggcagtgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctg

SEQ ID NO: 154 - protein, 249 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVL

SEQ ID NO: 155 - DNA, 747 bp, Homo sapiens
caggttcaattggttgaaagcggtggtggtctggttcagcctggtggtagcctgcgtctgagctgtgcagcaagcggttttacctttagcgattatgtgattaattgggttcgtcaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggtggtagcggtggtggcggatctggtggcggtggttcaggtggtggtggcagtgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctg

SEQ ID NO: 156 - protein, 249 aa, Homo sapiens; identical to SEQ ID NO: 154

SEQ ID NO: 157 - DNA, 723 bp, Homo sapiens
gatatcgaactgacccagcctccgagcgttagcgttgcaccgggtcagaccgcacgtattagctgtagcggtgataatattggcagcaaatatgtgcattggtatcagcagaaaccgggtcaggcaccggttctggttatttatggtgatagcaatcgtccgagcggtattccggaacgttttagcggtagcaatagcggtaataccgcaaccctgaccattagcggcacccaggcagaagatgaagcagattattattgtacccgtaccagcaccccgattagcggtgtttttggtggtggcaccaagcttaccgttctgggtggtggtggtagcggtggtggtggctcaggtggtggtggttcacaggttcaattggttgaaagtggtggtggtctggttcagcctggtggtagcctgcgtctgagctgtgcagcaagcggttttacctttagcgttaatggtatgcattgggttcgccaggcaccgggtaaaggtctggaatgggttagcgttattgatggtatgggccatacctattatgccgatagcgttaaaggtcgttttaccattagccgtgataatagcaaaaataccctgtatctgcagatgaatagcctgcgtgcagaagataccgcagtttattattgcgcacgctatgattatattaaatatggtgcctttgatccgtggggtcagggtacactagttaccgttagcagc

SEQ ID NO: 158 - protein, 246 aa, Homo sapiens
DIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVLGGGGSGGGGSGGGGSGGGGSQVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSS

SEQ ID NO: 159 - DNA, 738 bp, Homo sapiens
gatatcgaactgacccagcctccgagcgttagcgttgcaccgggtcagaccgcacgtattagctgtagcggtgataatattggcagcaaatatgtgcattggtatcagcagaaaccgggtcaggcaccggttctggttatttatggtgatagcaatcgtccgagcggtattccggaacgttttagcggtagcaatagcggtaataccgcaaccctgaccattagcggcacccaggcagaagatgaagcagattattattgtacccgtaccagcaccccgattagcggtgtttttggtggtggcaccaagcttaccgttctgggtggtggtggtagcggtggtggtggctcaggtggtggcggttctggtggcggtggttcacaggttcaattggttgaaagtggtggtggtctggttcagcctggtggtagcctgcgtctgagctgtgcagcaagcggttttacctttagcgttaatggtatgcattgggttcgccaggcaccgggtaaaggtctggaatgggttagcgttattgatggtatgggccatacctattatgccgatagcgttaaaggtcgttttaccattagccgtgataatagcaaaaataccctgtatctgcagatgaatagcctgcgtgcagaagataccgcagtttattattgcgcacgctatgattatattaaatatggtgcctttgatccgtggggtcagggtacactagttaccgttagcagc

SEQ ID NO: 160 - protein, 246 aa, Homo sapiens; identical to SEQ ID NO: 158

SEQ ID NO: 161 - DNA, 723 bp, Homo sapiens
caggttcaattggttgaaagcggtggtggtctggttcagcctggtggtagcctgcgtctgagctgtgcagcaagcggttttacctttagcgttaatggtatgcattgggttcgtcaggcaccgggtaaaggtctggaatgggttagcgttattgatggtatgggccatacctattatgccgatagcgttaaaggtcgttttaccattagccgtgataatagcaaaaataccctgtatctgcagatgaatagcctgcgtgcagaagataccgcagtttattattgtgcccgttatgattatattaaatatggtgcctttgatccgtggggtcagggtacactagttaccgttagcagtggtggtggtggtagcggtggtggcggatctggtggcggtggttcagatatcgaactgacccagcctccgagcgttagcgttgcaccgggtcagaccgcacgtattagctgtagcggtgataatattggcagcaaatatgtgcattggtatcagcagaaaccgggtcaggctccggttctggttatttatggtgatagcaatcgtccgagcggtattccggaacgttttagcggtagcaatagcggtaataccgcaaccctgaccattagcggcacccaggcagaagatgaagccgattattattgcacccgtaccagcaccccgattagcggtgtttttggtggtggcaccaagcttaccgttctg

SEQ ID NO: 162 - protein, 241 aa, Homo sapiens
QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSSGGGGSGGGGSGGGGSDIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVL

SEQ ID NO: 163 - DNA, 738 bp, Homo sapiens
caggttcaattggttgaaagcggtggtggtctggttcagcctggtggtagcctgcgtctgagctgtgcagcaagcggttttacctttagcgttaatggtatgcattgggttcgtcaggcaccgggtaaaggtctggaatgggttagcgttattgatggtatgggccatacctattatgccgatagcgttaaaggtcgttttaccattagccgtgataatagcaaaaataccctgtatctgcagatgaatagcctgcgtgcagaagataccgcagtttattattgtgcccgttatgattatattaaatatggtgcctttgatccgtggggtcagggtacactagttaccgttagcagtggtggtggtggtagcggtggtggcggatctggtggcggtggttcaggtggtggtggcagtgatatcgaactgacccagcctccgagcgttagcgttgcaccgggtcagaccgcacgtattagctgtagcggtgataatattggcagcaaatatgtgcattggtatcagcagaaaccgggtcaggctccggttctggttatttatggtgatagcaatcgtccgagcggtattccggaacgttttagcggtagcaatagcggtaataccgcaaccctgaccattagcggcacccaggcagaagatgaagccgattattattgcacccgtaccagcaccccgattagcggtgtttttggtggtggcaccaagcttaccgttctg

SEQ ID NO: 164 - protein, 246 aa, Homo sapiens
QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSSGGGGSGGGGSGGGGSGGGGSDIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVL

SEQ ID NO: 165 - DNA, 2121 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcaagggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagc

SEQ ID NO: 166 - protein, 707 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 167 - protein, 105 aa, Homo sapiens; identical to SEQ ID NO: 13

SEQ ID NO: 168 - DNA, 315 bp, Homo sapiens
gacatcgagctgacccagcccccttctgtgtctgtggcccctggccagaccgccagaatcagctgcagcggcgacagcctgcggaacaaggtgtactggtatcagcagaagcccggccaggctcccgtgctggtgatctacaagaacaaccggcccagcggcatccctgagcggttcagcggcagcaacagcggcaataccgccaccctgaccatcagcggcacccaggccgaagatgaggccgactactactgccagagctacgacggccagaaaagcctggtgttcggcggaggcaccaagcttaccgtgctg

SEQ ID NO: 169 - DNA, 633 bp, Homo sapiens
gacatcgagctgacccagcccccttctgtgtctgtggcccctggccagaccgccagaatcagctgcagcggcgacagcctgcggaacaaggtgtactggtatcagcagaagcccggccaggctcccgtgctggtgatctacaagaacaaccggcccagcggcatccctgagcggttcagcggcagcaacagcggcaataccgccaccctgaccatcagcggcacccaggccgaagatgaggccgactactactgccagagctacgacggccagaaaagcctggtgttcggcggaggcaccaagcttaccgtgctgggccagcccaaagccgcccctagcgtgaccctgttcccccccagcagcgaggaactgcaggccaacaaggccaccctggtctgcctgatcagcgacttctaccctggcgccgtgaccgtggcctggaaggccgacagcagccccgtgaaggccggcgtggagacaaccacccccagcaagcagagcaacaacaagtacgccgccagcagctacctgagcctgacccccgagcagtggaagagccacagaagctacagctgccaggtcacccacgagggcagcaccgtggagaaaaccgtggcccccaccgagtgcagc

SEQ ID NO: 170 - protein, 211 aa, Homo sapiens; identical to SEQ ID NO: 17

SEQ ID NO: 171 - protein, 706 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 172 - DNA, 2118 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagc

SEQ ID NO: 173 - protein, 707 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDAVDTATYYCARMHLPLVFDSWGQGTLVTVSS

SEQ ID NO: 174 - DNA, 2121 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcaagggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggacgccgtggacaccgccacctattattgcgcccggatgcatctgcccctggtgttcgatagctggggccagggaaccctggtgacagtgtccagc

SEQ ID NO: 175 - protein, 707 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMTAVDTATYYCARMHLPLVFDSWGQGTLVTVSS

SEQ ID NO: 176 - DNA, 2121 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcaagggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatgaccgccgtggacaccgccacctattattgcgcccggatgcatctgcccctggtgttcgatagctggggccagggaaccctggtgacagtgtccagc

SEQ ID NO: 177 - protein, 464 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSGGSGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 178 - DNA, 1392 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagcggcggctccggcggaagcgacatcgagctgacccagcccccttctgtgtctgtggcgcccgggcagaccgccagaatcagctgcagcggcgacagcctgcggaacaaggtgtactggtatcagcagaagcccggccaggctcccgtgctggtgatctacaagaacaaccggcccagcggcatccctgagcggttcagcggcagcaacagcggcaataccgccaccctgaccatcagcggcacccaggccgaagatgaggccgactactactgccagagctacgacggccagaaaagcctggtgttcggcggaggcaccaagcttaccgtgctgggccagcccaaagccgcccctagcgtgaccctgttcccccccagcagcgaggaactgcaggccaacaaggccaccctggtctgcctgatcagcgacttctaccctggcgccgtgaccgtggcctggaaggccgacagcagccccgtgaaggccggcgtggagacaaccacccccagcaagcagagcaacaacaagtacgccgccagcagctacctgagcctgacccccgagcagtggaagagccacagaagctacagctgccaggtcacccacgagggcagcaccgtggagaaaaccgtggcccccaccgagtgcagc

SEQ ID NO: 179 - protein, 124 aa, Homo sapiens; identical to SEQ ID NO: 14

SEQ ID NO: 180 - DNA, 372 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctca

SEQ ID NO: 181 - protein, 454 aa, Homo sapiens; identical to SEQ ID NO: 18

SEQ ID NO: 182 - DNA, 1362 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagagcctgagcctgtcccccggcaag

SEQ ID NO: 183 - protein, 108 aa, Homo sapiens; identical to SEQ ID NO: 81

SEQ ID NO: 184 - DNA, 324 bp, Homo sapiens; identical to SEQ ID NO: 83

SEQ ID NO: 185 - protein, 215 aa, Homo sapiens; identical to SEQ ID NO: 85

SEQ ID NO: 186 - DNA, 645 bp, Homo sapiens
gatatcgtgctgacccagagcccggcgaccctgagcctgtctccgggcgaacgtgcgaccctgagctgcagagcgagccagtttattggttctcgttatctggcttggtaccagcagaaaccaggtcaagcaccgcgtctattaatttatggtgcttctaatcgtgcaactggggtcccggcgcgttttagcggctctggatccggcacggattttaccctgaccattagcagcctggaacctgaagactttgcgacttattattgccagcagtattatgattatcctcagacctttggccagggtacgaaagttgaaattaaacgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 187 - protein, 699 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSQVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVL

SEQ ID NO: 188 - DNA, 2097 bp, Homo sapiens
caggtgcaattgaaagaaagcggcccggccctggtgaaaccgacccaaaccctgaccctgacctgtaccttttccggatttagcctgtctaatcgtggtggtggtgtgggttggattcgccagccgcctgggaaagccctcgagtggctggcttggatcgattgggatgatgataagtcttatagcaccagcctgaaaacgcgtctgaccattagcaaagatacttcgaaaaatcaggtggtgctgactatgaccaacatggacccggtggatacggccacctattattgcgcgcgtatgcatcttcctcttgtttttgattcttggggccaaggcaccctggtgacggttagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcaagggcggctccggcggaagccaggttcaattggttgaaagcggtggtggtctggttcagcctggtggtagcctgcgtctgagctgtgcagcaagcggttttacctttagcgattatgtgattaattgggttcgtcaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggtggtagcggtggtggcggatctggtggcggtggcagtgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctg

SEQ ID NO: 189 - protein, 704 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSQVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVL

SEQ ID NO: 190 - DNA, 2112 bp, Homo sapiens
caggtgcaattgaaagaaagcggcccggccctggtgaaaccgacccaaaccctgaccctgacctgtaccttttccggatttagcctgtctaatcgtggtggtggtgtgggttggattcgccagccgcctgggaaagccctcgagtggctggcttggatcgattgggatgatgataagtcttatagcaccagcctgaaaacgcgtctgaccattagcaaagatacttcgaaaaatcaggtggtgctgactatgaccaacatggacccggtggatacggccacctattattgcgcgcgtatgcatcttcctcttgtttttgattcttggggccaaggcaccctggtgacggttagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcaagggcggctccggcggaagccaggttcaattggttgaaagcggtggtggtctggttcagcctggtggtagcctgcgtctgagctgtgcagcaagcggttttacctttagcgattatgtgattaattgggttcgtcaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggtggtagcggtggtggcggatctggtggcggtggttcaggtggtggtggcagtgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctg

SEQ ID NO: 191 - protein, 105 aa, Homo sapiens; identical to SEQ ID NO: 13

SEQ ID NO: 192 - DNA, 315 bp, Homo sapiens
gacatcgagctgactcagccccctagcgtgtcagtggctcctggccagaccgctagaattagctgtagcggcgatagcctgcgtaacaaggtctactggtatcagcagaagcccggccaggcccctgtgctggtcatctataagaacaataggcctagcggcatccccgagcggtttagcggctctaatagcggcaacaccgctaccctgactattagcggcactcaggccgaggacgaggccgactactactgtcagtcctacgacggccagaagtcactggtctttggcggcggaactaagctgaccgtgctg

SEQ ID NO: 193 - protein, 211 aa, Homo sapiens; identical to SEQ ID NO: 17

SEQ ID NO: 194 - DNA, 633 bp, Homo sapiens
gacatcgagctgactcagccccctagcgtgtcagtggctcctggccagaccgctagaattagctgtagcggcgatagcctgcgtaacaaggtctactggtatcagcagaagcccggccaggcccctgtgctggtcatctataagaacaataggcctagcggcatccccgagcggtttagcggctctaatagcggcaacaccgctaccctgactattagcggcactcaggccgaggacgaggccgactactactgtcagtcctacgacggccagaagtcactggtctttggcggcggaactaagctgaccgtgctgggacagcctaaggctgcccccagcgtgaccctgttcccccccagcagcgaggagctgcaggccaacaaggccaccctggtgtgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggaaaagaccgtggccccaaccgagtgcagc

SEQ ID NO: 195 - protein, 707 aa, Homo sapiens; identical to SEQ ID NO: 166

SEQ ID NO: 196 - DNA, 2121 bp, Homo sapiens
caggtgcagctggtggaatcaggcggaggactggtccagcctggcggatcacttagactgagctgtgccgctagtggcttcacctttagcgactatgtgattaactgggtccgacaggcccctggcaagggactggaatgggtgtcaggcattagttggagcggcgtgaacactcactacgccgatagcgtgaagggccggttcactattagccgggataactctaagaacaccctgtacctgcagatgaatagcctgagagccgaggacaccgccgtctactactgcgctagactgggcgctaccgctaacaacatccgctataagttcatggacgtgtggggccagggcaccctggtcacagtgtcttcagctagcactaagggcccctcagtgttccccctggcccctagctctaagtctactagcggtggcaccgccgctctgggctgcctggtcaaggactacttccccgagcccgtgaccgtgtcttggaatagcggcgctctgactagcggagtgcacaccttccccgccgtgctgcagtctagcggcctgtatagcctgtctagcgtcgtgaccgtgcctagctctagcctgggcactcagacctatatctgtaacgtgaaccacaagcctagtaacactaaggtggacaagcgggtggaacctaagtcttgcgataagactcacacctgtcccccctgccctgccccagaagctgctggcggacctagcgtgttcctgttcccacctaagcctaaagacaccctgatgattagtaggacccccgaagtgacctgcgtggtggtggacgtcagccacgaggaccctgaagtgaagttcaattggtatgtggacggcgtggaagtgcacaacgctaagactaagcctagagaggaacagtataactccacctatagggtggtgtcagtgctgaccgtgctgcaccaggactggctgaacggcaaagagtataagtgtaaagtctctaacaaggccctgcctgcccctatcgaaaagactatctctaaggctaagggccagcctagagaaccccaggtctacaccctgccccctagtagagaagagatgactaagaatcaggtgtccctgacctgtctggtcaagggcttctaccctagcgatatcgccgtggagtgggagtctaacggccagcccgagaacaactataagactaccccccctgtgctggatagcgacggctctttcttcctgtactctaaactgaccgtggacaagtctaggtggcagcagggcaacgtgttcagctgtagcgtgatgcacgaggccctgcacaatcactacactcagaagtcactgagcctgagtcccggcaagggcggctcaggcggtagcgatatcgtgctgactcagtcacccgctaccctgagtctgagccctggcgagcgggctacactgagctgtagagctagtcagtttatcggctcacgctacctggcctggtatcagcagaagcccggccaggcccctagactgctgatctacggcgctagtaatagagctaccggcgtgcccgctaggtttagcggctcaggatcaggcaccgactttaccctgactattagtagcctggaacccgaggacttcgctacctactactgtcagcagtactacgactaccctcagaccttcggccagggaactaaggtcgagattaagggcggtggcggtagcggcggaggcggatcaggtggtggtggtagtggcggcggaggtagtcaggtccagctgaaagagtcaggccctgccctggtcaagcctactcagaccctgaccctgacctgcacttttagcggctttagcctgagtaatagaggcggcggagtgggctggattagacagcctccaggcaaagccctggagtggctggcctggatcgactgggacgacgataagtcctactccactagcctgaaaactaggctgacaatcagcaaggacactagtaaaaaccaggtggtgctgactatgactaatatggaccccgtggacaccgctacctattattgcgctagaatgcacctcccactggtgttcgatagctggggtcagggaactctggtcacagtcagtagc

SEQ ID NO: 197 - protein, 105 aa, Homo sapiens
SYELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVL

SEQ ID NO: 198 - DNA, 315 bp, Homo sapiens
tcttacgagctgacccagcccccttccgtgtctgtggctcctggccagaccgccagaatctcttgctccggcgactccctgcggaacaaggtgtactggtatcagcagaagcccggccaggcccctgtgctggtcatctacaagaacaaccggccctccggcatccccgagagattctctggctccaactccggcaacaccgccaccctgacaatctctggcacacaggccgaggacgaggccgactactactgccagtcctacgacggccagaaatcactggtgttcggcggaggcaccaagctgacagtgctg

SEQ ID NO: 199 - protein, 211 aa, Homo sapiens
SYELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 200 - DNA, 633 bp, Homo sapiens
tcttacgagctgacccagcccccttccgtgtctgtggctcctggccagaccgccagaatctcttgctccggcgactccctgcggaacaaggtgtactggtatcagcagaagcccggccaggcccctgtgctggtcatctacaagaacaaccggccctccggcatccccgagagattctctggctccaactccggcaacaccgccaccctgacaatctctggcacacaggccgaggacgaggccgactactactgccagtcctacgacggccagaaatcactggtgttcggcggaggcaccaagctgacagtgctgggacagcctaaggctgcccccagcgtgaccctgttcccccccagcagcgaggagctgcaggccaacaaggccaccctggtgtgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggaaaagaccgtggccccaaccgagtgcagc

SEQ ID NO: 201 - protein, 707 aa, Homo sapiens; identical to SEQ ID NO: 166

SEQ ID NO: 202 - DNA, 2121 bp, Homo sapiens; identical to SEQ ID NO: 196

SEQ ID NO: 203 - protein, 105 aa, Homo sapiens
SYELTQPLSVSVALGQTARITCSGDSLRNKVYWYQQKPGQAPVLVIYKNNRPSGIPERFSGSNSGNTATLTISRAQAGDEADYYCQSYDGQKSLVFGGGTKLTVL

SEQ ID NO: 204 - DNA, 315 bp, Homo sapiens
agctacgagctgactcagcccctgagcgtgtcagtggctctgggccagaccgctagaatcacctgtagcggcgatagcctgagaaacaaggtctactggtatcagcagaagcccggccaggcccctgtgctggtcatctataagaacaataggcctagcggcatccccgagcggtttagcggctctaatagcggcaacaccgctaccctgactattagtagggctcaggccggcgacgaggccgactactactgtcagtcctacgacggccagaagtcactggtctttggcggcggaactaagctgaccgtgctg

SEQ ID NO: 205 - protein, 211 aa, Homo sapiens
SYELTQPLSVSVALGQTARITCSGDSLRNKVYWYQQKPGQAPVLVIYKNNRPSGIPERFSGSNSGNTATLTISRAQAGDEADYYCQSYDGQKSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 206 - DNA, 633 bp, Homo sapiens
agctacgagctgactcagcccctgagcgtgtcagtggctctgggccagaccgctagaatcacctgtagcggcgatagcctgagaaacaaggtctactggtatcagcagaagcccggccaggcccctgtgctggtcatctataagaacaataggcctagcggcatccccgagcggtttagcggctctaatagcggcaacaccgctaccctgactattagtagggctcaggccggcgacgaggccgactactactgtcagtcctacgacggccagaagtcactggtctttggcggcggaactaagctgaccgtgctgggacagcctaaggctgcccccagcgtgaccctgttcccccccagcagcgaggagctgcaggccaacaaggccaccctggtgtgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggaaaagaccgtggccccaaccgagtgcagc

SEQ ID NO: 207 - protein, 707 aa, Homo sapiens
EVQLLESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 208 - DNA, 2121 bp, Homo sapiens
gaggtgcagctgctggaatcaggcggaggactggtgcagcctggcggatcactgagactgagctgtgccgctagtggcttcacctttagcgactatgtgattaactgggtccgacaggcccctggcaagggactggaatgggtgtcaggcattagttggagcggcgtgaacactcactacgccgatagcgtgaagggccggttcactattagccgggataactctaagaacaccctgtacctgcagatgaatagcctgagagccgaggacaccgccgtctactactgcgctagactgggcgctaccgctaacaacatccgctataagttcatggacgtgtggggccagggcaccctggtcacagtgtcttcagctagcactaagggcccctcagtgttccccctggcccctagctctaagtctactagcggtggcaccgccgctctgggctgcctggtcaaggactacttccccgagcccgtgaccgtgtcttggaatagcggcgctctgactagcggagtgcacaccttccccgccgtgctgcagtctagcggcctgtatagcctgtctagcgtcgtgaccgtgcctagctctagcctgggcactcagacctatatctgtaacgtgaaccacaagcctagtaacactaaggtggacaagcgggtggaacctaagtcttgcgataagactcacacctgtcccccctgccctgccccagaagctgctggcggacctagcgtgttcctgttcccacctaagcctaaagacaccctgatgattagtaggacccccgaagtgacctgcgtggtggtggacgtcagccacgaggaccctgaagtgaagttcaattggtatgtggacggcgtggaagtgcacaacgctaagactaagcctagagaggaacagtataactccacctatagggtggtgtcagtgctgaccgtgctgcaccaggactggctgaacggcaaagagtataagtgtaaagtctctaacaaggccctgcctgcccctatcgaaaagactatctctaaggctaagggccagcctagagaaccccaggtctacaccctgccccctagtagagaagagatgactaagaatcaggtgtccctgacctgtctggtcaagggcttctaccctagcgatatcgccgtggagtgggagtctaacggccagcccgagaacaactataagactaccccccctgtgctggatagcgacggctctttcttcctgtactctaaactgaccgtggacaagtctaggtggcagcagggcaacgtgttcagctgtagcgtgatgcacgaggccctgcacaatcactacactcagaagtcactgagcctgagtcccggcaagggcggctcaggcggtagcgatatcgtgctgactcagtcacccgctaccctgagtctgagccctggcgagcgggctacactgagctgtagagctagtcagtttatcggctcacgctacctggcctggtatcagcagaagcccggccaggcccctagactgctgatctacggcgctagtaatagagctaccggcgtgcccgctaggtttagcggctcaggatcaggcaccgactttaccctgactattagtagcctggaacccgaggacttcgctacctactactgtcagcagtactacgactaccctcagaccttcggccagggaactaaggtcgagattaagggcggtggcggtagcggcggaggcggatcaggtggtggtggtagtggcggcggaggtagtcaggtccagctgaaagagtcaggccctgccctggtcaagcctactcagaccctgaccctgacctgcacttttagcggctttagcctgagtaatagaggcggcggagtgggctggattagacagcctccaggcaaagccctggagtggctggcctggatcgactgggacgacgataagtcctactccactagcctgaaaactaggctgacaatcagcaaggacactagtaaaaaccaggtggtgctgactatgactaatatggaccccgtggacaccgctacctattattgcgctagaatgcacctcccactggtgttcgatagctggggtcagggaactctggtcacagtcagtagc

SEQ ID NO: 209 - protein, 585 aa, Homo sapiens [sequence omitted]

SEQ ID NO: 210 - protein, 585 aa, Homo sapiens
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGL

SEQ ID NO: 211 - protein, 211 aa, Homo sapiens; identical to SEQ ID NO: 17

SEQ ID NO: 212 - DNA, 633 bp, Homo sapiens
gatatcgaactgacccagccgccttcagtgagcgttgcaccaggtcagaccgcgcgtatctcgtgtagcggcgattctcttcgtaataaggtttattggtaccagcagaaacccgggcaggcgccagttcttgtgatttataagaataatcgtccctcaggcatcccggaacgctttagcggatccaacagcggcaacaccgcgaccctgaccattagcggcactcaggcggaagacgaagcggattattattgccagtcttatgatggtcagaagtctcttgtgtttggcggcggcacgaagcttaccgtgctgggccagcccaaagccgcccctagcgtgaccctgttcccccccagcagcgaggaactgcaggccaacaaggccaccctggtctgcctgatcagcgacttctaccctggcgccgtgaccgtggcctggaaggccgacagcagccccgtgaaggccggcgtggagacaaccacccccagcaagcagagcaacaacaagtacgccgccagcagctacctgagcctgacccccgagcagtggaagagccacagaagctacagctgccaggtcacccacgagggcagcaccgtggagaaaaccgtggcccccaccgagtgcagc

SEQ ID NO: 213 - protein, 822 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 214 - DNA, 2466 bp, Homo sapiens
caggtgcaattggtggaaagcggcggcggcctggtgcaaccgggcggcagcctgcgtctgagctgcgcggcctccggatttaccttttctgattatgttattaattgggtgcgccaagcccctgggaagggtctcgagtgggtgagcggtatttcttggtctggtgttaatactcattatgctgattctgttaagggtcgttttaccatttcacgtgataattcgaaaaacaccctgtatctgcaaatgaacagcctgcgtgcggaagatacggccgtgtattattgcgcgcgtcttggtgctactgctaataatattcgttataagtttatggatgtttggggccaaggcaccctggtgacggttagctcagctagcaccaagggccccagcgtgttccccctggcccccagcagcaagagcacctctggcggcactgctgccctgggctgcctggtcaaggactacttccccgagcccgtgacagtgtcctggaacagcggagccctgacctccggcgtgcacaccttccccgccgtgctgcagagcagcggcctgtacagcctgagcagcgtggtcacagtgcccagcagcagcctgggcacccagacctacatctgcaacgtgaaccacaagcccagcaacaccaaggtcgacaagaaggtggagcccaagagctgcgacaagacccacaccgaggcccacaagagcgagatcgcccaccggtacaacgacctgggagagcagcatttcaagggactggtgctgatcgccttcagccagtacctgcagaagtgcagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtgcaaggacgccctggcccaccatcatcaccatcac

SEQ ID NO: 215 - protein, 211 aa, Homo sapiens; identical to SEQ ID NO: 17

SEQ ID NO: 216 - DNA, 633 bp, Homo sapiens; identical to SEQ ID NO: 169

SEQ ID NO: 217 - protein, 822 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTEAHKSEIAHRYNDLGEQHFKGLVLIAFSQYLQKSSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRSKDALAHHHHHH

SEQ ID NO: 218 - DNA, 2466 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcacctctggcggcactgctgccctgggctgcctggtcaaggactacttccccgagcccgtgacagtgtcctggaacagcggagccctgacctccggcgtgcacaccttccccgccgtgctgcagagcagcggcctgtacagcctgagcagcgtggtcacagtgcccagcagcagcctgggcacccagacctacatctgcaacgtgaaccacaagcccagcaacaccaaggtcgacaagaaggtggagcccaagagctgcgacaagacccacaccgaggcccacaagagcgagatcgcccaccggtacaacgacctgggagagcagcatttcaagggactggtgctgatcgccttcagccagtacctgcagaagtccagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtccaaggacgccctggcccaccatcatcaccatcac

SEQ ID NO: 219 - protein, 211 aa, Homo sapiens; identical to SEQ ID NO: 17

SEQ ID NO: 220 - DNA, 633 bp, Homo sapiens; identical to SEQ ID NO: 169

SEQ ID NO: 221 - protein, 817 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 222 - DNA, 2451 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggccccctccagcaagtccacaagcggtggcacagcagctctgggttgcctggtgaaggactacttccccgagcccgtgacagtgtcctggaactctggcgccctgacctccggcgtgcacaccttccccgccgtgctgcagagcagcggcctgtacagcctgagcagcgtggtgacagtccccagcagcagcttgggcacccagacctacatctgcaacgtgaaccacaagcccagcaacaccaaggtggacaagaaggtggagcccaagagctgcgacaagacccacaccgacgcccacaagagcgaggtggcccaccggttcaaggacctgggcgaggaaaacttcaaggccctggtgctgatcgccttcgcccagtacctgcagcagagccccttcgaagatcacgtaaagttagtcaacgaggttacggaattcgcaaagacatgcgttgctgacgaatccgctgagaattgtgacaagagtttgcacactttattcggagataagttgtgtactgtagctactttgagagagacttacggtgaaatggctgactgctgtgcaaaacaggaaccagaacgtaacgaatgtttccttcagcataaggatgataaccctaaccttccaaggcttgttaggccagaagtcgacgtgatgtgcaccgccttccatgataatgaagagacttttcttaaaaagtacctatacgagattgcaaggcgtcatccatatttttacgccccagagctgttgtttttcgcaaagagatacaaagctgcatttactgagtgttgccaagctgccgacaaggccgcttgtttgctaccaaagttggacgaattgagagacgagggtaaggcatcatctgccaagcagagattaaaatgtgcatctttgcaaaaatttggagagagagcttttaaggcatgggctgttgcccgactaagccaaagattcccaaaagccgaatttgctgaagtatccaagctggtgactgatttgactaaagtacatacagaatgttgccatggcgaccttttagaatgtgctgatgacagagcagatttggctaagtatatctgcgaaaatcaagattcaatcagctctaagctgaaggaatgttgcgagaaaccactgttagaaaaatcgcattgtattgctgaagttgaaaatgatgagatgcctgctgacttgccttctcttgccgctgattttgttgagtcgaaggatgtctgtaagaattatgctgaagctaaagacgttttcctgggtatgttcttatatgagtacgcaagacgtcacccagattactctgtggttctgctactgagattggctaaaacatacgagacaacgctggagaagtgctgtgctgccgctgaccctcatgagtgctatgcaaaggtttttgatgaattcaaaccattggttgaagagcctcaaaacttgataaagcagaactgtgagctgtttgagcaattgggtgagtataagttccaaaatgccctgttggtgagatatacaaaaaaggtaccccaagtttcaacgcccactttagttgaagtgtccagaaatcttggtaaagtgggtagcaaatgttgcaagcatccagaagccaagcgaatgccctgtgctgaggattatctgtccgtcgtgttgaaccaattgtgcgtattacacgaaaaaaccccagtctctgatagagtcaccaaatgttgcactgagtcactagttaatagaaggccttgtttttccgctttggaagttgatgaaacctacgtgcctaaggaatttaacgctgagacctttacctttcacgctgacatttgtactttgagtgaaaaagagcgtcaaatcaaaaagcaaaccgctcttgttgaattggtgaaacacaagcctaaggctacgaaggagcagcttaaagccgtcatggacgatttcgccgcatttgttgaaaaatgctgtaaagctgatgacaaggaaacatgtttcgctgaagagggaaagaaattggttgcggccagtcaggccgcacttggtttg

SEQ ID NO: 223 - protein, 213 aa, Homo sapiens
DIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 224 - DNA, 639 bp, Homo sapiens
gacatcgagctgacccagccccccagcgtgtctgtggcccctggccagaccgcccggatcagctgcagcggcgacaacatcggcagcaaatacgtgcactggtatcagcagaagcccggccaggcccccgtgctggtcatctacggcgacagcaaccggcccagcggcatccccgagcggttcagcggcagcaacagcggcaacaccgccaccctgaccatcagcggcacccaggccgaggacgaggccgactactactgcacccggaccagcacccccatctccggcgtgtttggcggcggaacaaagctgaccgtgctgggccagcccaaagccgcccctagcgtgaccctgttcccccccagcagcgaggaactgcaggccaacaaggccaccctggtctgcctgatcagcgacttctaccctggcgccgtgaccgtggcctggaaggccgacagcagccccgtgaaggccggcgtggagacaaccacccccagcaagcagagcaacaacaagtacgccgccagcagctacctgagcctgacccccgagcagtggaagagccacagaagctacagctgccaggtcacccacgagggcagcaccgtggagaaaaccgtggcccccaccgagtgcagc

SEQ ID NO: 225 - protein, 817 aa, Homo sapiens
QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 226 - DNA, 2451 bp, Homo sapiens
caggtgcagctggtcgagtctggcgggggactggtccagcctggcggcagcctgagactgagctgcgccgccagcggcttcaccttcagcgtgaacggcatgcactgggtccgccaggcaccaggcaagggcctggaatgggtgtccgtgatcgacggcatgggccacacctactacgccgacagcgtgaagggccggttcaccatcagccgggacaacagcaagaacaccctgtacctgcagatgaacagcctgcgggccgaggacaccgccgtgtactactgcgccagatacgactacatcaagtacggcgccttcgacccctggggccagggcacactggtcaccgtgtccagcgctagcaccaagggccccagcgtgttccccctggcccccagcagcaagagcacctctggcggcactgctgccctgggctgcctggtcaaggactacttccccgagcccgtgacagtgtcctggaacagcggagccctgacctccggcgtgcacaccttccccgccgtgctgcagagcagcggcctgtacagcctgagcagcgtggtcacagtgcccagcagcagcctgggcacccagacctacatctgcaacgtgaaccacaagcccagcaacaccaaggtggacaagaaggtggagcccaagagctgcgacaagacccacaccgaggcccacaagagcgagatcgcccaccggtacaacgacctgggagagcagcatttcaagggactggtgctgatcgccttcagccagtacctgcagaagtgcagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtgcaaggacgccctggcccaccatcatcaccatcac

SEQ ID NO: 227 - protein, 212 aa, Homo sapiens
DIELTQPPSVSVAPGQTARISCSGDNIGSKYVHWYQQKPGQAPVLVIYGDSNRPSGIPERFSGSNSGNTATLTISGTQAEDEADYYCSSYDLARTVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 228 - DNA, 636 bp, Homo sapiens
gacatcgagctgacccagccccccagcgtgtctgtggcccctggccagaccgcccggatcagctgcagcggcgacaacatcggcagcaaatacgtgcactggtatcagcagaagcccggccaggcccccgtgctggtcatctacggcgacagcaaccggcccagcggcatccccgagcggttcagcggcagcaacagcggcaacaccgccaccctgaccatcagcggcacccaggccgaggacgaggccgactactactgcagcagctacgacctggcccggaccgtgtttggcggcggaacaaagctgaccgtgctgggccagcccaaagccgcccctagcgtgaccctgttcccccccagcagcgaggaactgcaggccaacaaggccaccctggtctgcctgatcagcgacttctaccctggcgccgtgaccgtggcctggaaggccgacagcagccccgtgaaggccggcgtggagacaaccacccccagcaagcagagcaacaacaagtacgccgccagcagctacctgagcctgacccccgagcagtggaagagccacagaagctacagctgccaggtcacccacgagggcagcaccgtggagaaaaccgtggcccccaccgagtgcagc

SEQ ID NO: 229 - protein, 818 aa, Homo sapiens
QVQLVESGGGLVQPGGSLRLSCAASGFTFSVNGMHWVRQAPGKGLEWVSNISGSSSFTYYADSVKGRFTISRDNSKNTLYLQMNSLRAEDTAVYYCARYDYIKYGAFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 230 - DNA, 2454 bp, Homo sapiens
caggtgcagctggtcgagtctggcgggggactggtccagcctggcggcagcctgagactgagctgcgccgccagcggcttcaccttcagcgtgaacggcatgcactgggtccgccaggcaccaggcaagggcctggaatgggtgtccaacatcagcggcagcagcagcttcacctactacgccgacagcgtgaagggccggttcaccatcagccgggacaacagcaagaacaccctgtacctgcagatgaacagcctgcgggccgaggacaccgccgtgtactactgcgccagatacgactacatcaagtacggcgccttcgacccctggggccagggcacactggtcaccgtgtccagcgctagcaccaagggccccagcgtgttccccctggcccccagcagcaagagcacctctggcggcactgctgccctgggctgcctggtcaaggactacttccccgagcccgtgacagtgtcctggaacagcggagccctgacctccggcgtgcacaccttccccgccgtgctgcagagcagcggcctgtacagcctgagcagcgtggtcacagtgcccagcagcagcctgggcacccagacctacatctgcaacgtgaaccacaagcccagcaacaccaaggtggacaagaaggtggagcccaagagctgcgacaagacccacaccgaggcccacaagagcgagatcgcccaccggtacaacgacctgggagagcagcatttcaagggactggtgctgatcgccttcagccagtacctgcagaagtgcagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtgcaaggacgccctggcccaccatcatcaccatcac

SEQ ID NO: 231 - protein, 214 aa, Homo sapiens; identical to SEQ ID NO: 65

SEQ ID NO: 232 - DNA, 642 bp, Homo sapiens
gatatcgaactgacccagccgccttcagtgagcgttgcaccaggtcagaccgcgcgtatctcgtgtagcggcgataatattcgtaagaagtatgtttattggtaccagcagaaacccgggcaggcgccagttcttgtgatttatgaggattctaagcgtccctcaggcatcccggaacgctttagcggatccaacagcggcaacaccgcgaccctgaccattagcggcactcaggcggaagacgaagcggattattattgctctactgctgattctggtattaataatggtgtgtttggcggcggcacgaagcttaccgtgctgggccagcccaaagccgcccctagcgtgaccctgttcccccccagcagcgaggaactgcaggccaacaaggccaccctggtctgcctgatcagcgacttctaccctggcgccgtgaccgtggcctggaaggccgacagcagccccgtgaaggccggcgtggagacaaccacccccagcaagcagagcaacaacaagtacgccgccagcagctacctgagcctgacccccgagcagtggaagagccacagaagctacagctgccaggtcacccacgagggcagcaccgtggagaaaaccgtggcccccaccgagtgcagc

SEQ ID NO: 233 - protein, 821 aa, Homo sapiens
QVQLVESGGGLVQPGGSLRLSCAASGFTFSDYAIHWVRQAPGKGLEWVSGISYSGSSTHYADSVKGRFTISRDNSKNTLYLQMNSLRAEDTAVYYCARGSHGNIMAKRYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 234 - DNA, 2463 bp, Homo sapiens
caggtgcaattggtggaaagcggcggcggcctggtgcaaccgggcggcagcctgcgtctgagctgcgcggcctccggatttaccttttctgattatgctattcattgggtgcgccaagcccctgggaagggtctcgagtgggtgagcggtatctcttattctggtagctctacccattatgcggatagcgtgaaaggccgttttaccatttcacgtgataattcgaaaaacaccctgtatctgcaaatgaacagcctgcgtgcggaagatacggccgtgtattattgcgcgcgtggttctcatggtaatattatggctaagcgttattttgatttttggggccaaggcaccctggtgacggttagctcagctagcaccaagggccccagcgtgttccccctggcccccagcagcaagagcacctctggcggcactgctgccctgggctgcctggtcaaggactacttccccgagcccgtgacagtgtcctggaacagcggagccctgacctccggcgtgcacaccttccccgccgtgctgcagagcagcggcctgtacagcctgagcagcgtggtcacagtgcccagcagcagcctgggcacccagacctacatctgcaacgtgaaccacaagcccagcaacaccaaggtcgacaagaaggtggagcccaagagctgcgacaagacccacaccgaggcccacaagagcgagatcgcccaccggtacaacgacctgggagagcagcatttcaagggactggtgctgatcgccttcagccagtacctgcagaagtgcagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtgcaaggacgccctggcccaccatcatcaccatcac

SEQ ID NO: 235 - protein, 215 aa, Homo sapiens; identical to SEQ ID NO: 85

SEQ ID NO: 236 - DNA, 645 bp, Homo sapiens; identical to SEQ ID NO: 186

SEQ ID NO: 237 - protein, 817 aa, Homo sapiens
QVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 238 - DNA, 2451 bp, Homo sapiens
caggtgcaattgaaagaaagcggcccggccctggtgaaaccgacccaaaccctgaccctgacctgtaccttttccggatttagcctgtctaatcgtggtggtggtgtgggttggattcgccagccgcctgggaaagccctcgagtggctggcttggatcgattgggatgatgataagtcttatagcaccagcctgaaaacgcgtctgaccattagcaaagatacttcgaaaaatcaggtggtgctgactatgaccaacatggacccggtggatacggccacctattattgcgcgcgtatgcatcttcctcttgtttttgattcttggggccaaggcaccctggtgacggttagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacaccgaggcccacaagagcgagatcgcccaccggtacaacgacctgggagagcagcatttcaagggactggtgctgatcgccttcagccagtacctgcagaagtgcagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtgcaaggacgccctggcccaccatcatcaccatcac

SEQ ID NO: 239 - protein, 847 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSGGGGSGGGGSEAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALAHHHHHH

SEQ ID NO: 240 - DNA, 2541 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagcggcggaggcggatccgggggtggcggaagtgaggcccacaagagcgagatcgcccaccggtacaacgacctgggagagcagcatttcaagggactggtgctgatcgccttcagccagtacctgcagaagtgcagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtgcaaggacgccctggcccaccatcatcaccatcac

SEQ ID NO: 241 - protein, 211 aa, Homo sapiens; identical to SEQ ID NO: 17

SEQ ID NO: 242 - DNA, 633 bp, Homo sapiens; identical to SEQ ID NO: 169

SEQ ID NO: 243 - protein, 1069 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTEAHKSEIAHRYNDLGEQHFKGLVLIAFSQYLQKSSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRSKDALAGGSGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 244 - DNA, 3207 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacacttgtgaccgtcagctcagctagcaccaagggccccagcgtgttccccctggcccccagcagcaagagcacctctggcggcactgctgccctgggctgcctggtcaaggactacttccccgagcccgtgacagtgtcctggaacagcggagccctgacctccggcgtgcacaccttccccgccgtgctgcagagcagcggcctgtacagcctgagcagcgtggtcacagtgcccagcagcagcctgggcacccagacctacatctgcaacgtgaaccacaagcccagcaacaccaaggtcgacaagaaggtggagcccaagagctgcgacaagacccacaccgaggcccacaagagcgagatcgcccaccggtacaacgacctgggagagcagcatttcaagggactggtgctgatcgccttcagccagtacctgcagaagtccagctacgacgagcacgccaagctggtgcaggaagtgaccgacttcgccaagacctgcgtggccgacgagagcgccgccaactgcgacaagagcctgcacaccctgttcggcgacaagctgtgcgccatccccaacctgcgggagaactacggcgagctggccgactgctgcaccaagcaggaacccgagcggaacgagtgcttcctgcagcacaaggacgacaaccccagcctgccccccttcgagaggcctgaggccgaggccatgtgcaccagcttcaaagagaaccccaccaccttcatgggccactacctgcacgaggtggccaggcggcacccctacttctacgcccccgagctgctgtactacgccgagcagtacaacgagatcctgacccagtgctgcgccgaggccgacaaagagagctgcctgacccccaagctggacggcgtgaaagaaaaggccctggtgtccagcgtgcggcagcggatgaagtgcagcagcatgcagaagttcggcgagcgggccttcaaggcctgggccgtggcccggctgtcccagaccttccccaacgccgatttcgccgagatcaccaagctggccaccgacctgaccaaggtgaacaaagagtgctgtcacggcgacctgctggaatgcgccgacgaccgggccgagctggccaagtacatgtgcgagaaccaggccaccatcagctccaaactgcagacctgctgtgataagcccctgctgaagaaggcccactgcctgagcgaggtggagcacgacaccatgcccgccgacctgcccgccattgccgccgacttcgtggaggaccaggaagtgtgcaagaattacgccgaggccaaggacgtgttcctgggcaccttcctgtacgagtacagcagacggcaccccgactacagcgtgagcctgctgctgaggctggccaagaagtacgaggccaccctggaaaagtgttgcgccgaagccaacccccctgcctgctacggcaccgtgctggccgagttccagcccctggtggaggaacccaagaacctggtgaaaaccaactgcgatctgtacgagaagctgggcgagtacggcttccagaacgccatcctggtccggtacacccagaaagccccccaggtgtccacccccacactggtggaggccgccaggaacctgggcagagtcggcaccaagtgctgcaccctgcccgaggatcagaggctgccctgtgtcgaggactacctgagcgccatcctgaacagagtgtgcctgctgcacgagaaaacccccgtgagcgagcacgtgaccaagtgttgcagcggcagcctggtggagcggaggccctgcttcagcgccctgaccgtggacgagacatacgtgcccaaagagttcaaggccgagacattcaccttccacagcgacatctgtaccctgcctgagaaagagaagcagatcaagaagcagaccgccctggccgaactggtgaagcacaagcccaaggccaccgccgagcagctgaaaaccgtgatggacgacttcgcccagttcctggacacctgctgcaaggccgccgacaaggacacctgtttcagcaccgagggccccaacctggtgacccggtccaaggacgccctggccggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagc

SEQ ID NO: 245 - protein, 211 aa, Homo sapiens; identical to SEQ ID NO: 17

SEQ ID NO: 246 - DNA, 633 bp, Homo sapiens; identical to SEQ ID NO: 169

SEQ ID NO: 247 - protein, 1070 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGSGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSS

SEQ ID NO: 248 - DNA, 3210 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggccccctccagcaagtccacaagcggtggcacagcagctctgggttgcctggtgaaggactacttccccgagcccgtgacagtgtcctggaactctggcgccctgacctccggcgtgcacaccttccccgccgtgctgcagagcagcggcctgtacagcctgagcagcgtggtgacagtccccagcagcagcttgggcacccagacctacatctgcaacgtgaaccacaagcccagcaacaccaaggtggacaagaaggtggagcccaagagctgcgacaagacccacaccgacgcccacaagagcgaggtggcccaccggttcaaggacctgggcgaggaaaacttcaaggccctggtgctgatcgccttcgcccagtacctgcagcagagccccttcgaagatcacgtaaagttagtcaacgaggttacggaattcgcaaagacatgcgttgctgacgaatccgctgagaattgtgacaagagtttgcacactttattcggagataagttgtgtactgtagctactttgagagagacttacggtgaaatggctgactgctgtgcaaaacaggaaccagaacgtaacgaatgtttccttcagcataaggatgataaccctaaccttccaaggcttgttaggccagaagtcgacgtgatgtgcaccgccttccatgataatgaagagacttttcttaaaaagtacctatacgagattgcaaggcgtcatccatatttttacgccccagagctgttgtttttcgcaaagagatacaaagctgcatttactgagtgttgccaagctgccgacaaggccgcttgtttgctaccaaagttggacgaattgagagacgagggtaaggcatcatctgccaagcagagattaaaatgtgcatctttgcaaaaatttggagagagagcttttaaggcatgggctgttgcccgactaagccaaagattcccaaaagccgaatttgctgaagtatccaagctggtgactgatttgactaaagtacatacagaatgttgccatggcgaccttttagaatgtgctgatgacagagcagatttggctaagtatatctgcgaaaatcaagattcaatcagctctaagctgaaggaatgttgcgagaaaccactgttagaaaaatcgcattgtattgctgaagttgaaaatgatgagatgcctgctgacttgccttctcttgccgctgattttgttgagtcgaaggatgtctgtaagaattatgctgaagctaaagacgttttcctgggtatgttcttatatgagtacgcaagacgtcacccagattactctgtggttctgctactgagattggctaaaacatacgagacaacgctggagaagtgctgtgctgccgctgaccctcatgagtgctatgcaaaggtttttgatgaattcaaaccattggttgaagagcctcaaaacttgataaagcagaactgtgagctgtttgagcaattgggtgagtataagttccaaaatgccctgttggtgagatatacaaaaaaggtaccccaagtttcaacgcccactttagttgaagtgtccagaaatcttggtaaagtgggtagcaaatgttgcaagcatccagaagccaagcgaatgccctgtgctgaggattatctgtccgtcgtgttgaaccaattgtgcgtattacacgaaaaaaccccagtctctgatagagtcaccaaatgttgcactgagtcactagttaatagaaggccttgtttttccgctttggaagttgatgaaacctacgtgcctaaggaatttaacgctgagacctttacctttcacgctgacatttgtactttgagtgaaaaagagcgtcaaatcaaaaagcaaaccgctcttgttgaattggtgaaacacaagcctaaggctacgaaggagcagcttaaagccgtcatggacgatttcgccgcatttgttgaaaaatgctgtaaagctgatgacaaggaaacatgtttcgctgaagagggaaagaaattggttgcggccagtcaggcagcgcttggtttgggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagc

SEQ ID NO: 249 - protein, 211 aa, Homo sapiens; identical to SEQ ID NO: 17

SEQ ID NO: 250 - DNA, 633 bp, Homo sapiens; identical to SEQ ID NO: 169

SEQ ID NO: 251 - protein, 1290 aa, Homo sapiens [sequence omitted]

SEQ ID NO: 252 - DNA, 3870 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggccccctccagcaagtccacaagcggtggcacagcagctctgggttgcctggtgaaggactacttccccgagcccgtgacagtgtcctggaactctggcgccctgacctccggcgtgcacaccttccccgccgtgctgcagagcagcggcctgtacagcctgagcagcgtggtgacagtccccagcagcagcttgggcacccagacctacatctgcaacgtgaaccacaagcccagcaacaccaaggtggacaagaaggtggagcccaagagctgcgacaagacccacaccgacgcccacaagagcgaggtggcccaccggttcaaggacctgggcgaggaaaacttcaaggccctggtgctgatcgccttcgcccagtacctgcagcagagccccttcgaagatcacgtaaagttagtcaacgaggttacggaattcgcaaagacatgcgttgctgacgaatccgctgagaattgtgacaagagtttgcacactttattcggagataagttgtgtactgtagctactttgagagagacttacggtgaaatggctgactgctgtgcaaaacaggaaccagaacgtaacgaatgtttccttcagcataaggatgataaccctaaccttccaaggcttgttaggccagaagtcgacgtgatgtgcaccgccttccatgataatgaagagacttttcttaaaaagtacctatacgagattgcaaggcgtcatccatatttttacgccccagagctgttgtttttcgcaaagagatacaaagctgcatttactgagtgttgccaagctgccgacaaggccgcttgtttgctaccaaagttggacgaattgagagacgagggtaaggcatcatctgccaagcagagattaaaatgtgcatctttgcaaaaatttggagagagagcttttaaggcatgggctgttgcccgactaagccaaagattcccaaaagccgaatttgctgaagtatccaagctggtgactgatttgactaaagtacatacagaatgttgccatggcgaccttttagaatgtgctgatgacagagcagatttggctaagtatatctgcgaaaatcaagattcaatcagctctaagctgaaggaatgttgcgagaaaccactgttagaaaaatcgcattgtattgctgaagttgaaaatgatgagatgcctgctgacttgccttctcttgccgctgattttgttgagtcgaaggatgtctgtaagaattatgctgaagctaaagacgttttcctgggtatgttcttatatgagtacgcaagacgtcacccagattactctgtggttctgctactgagattggctaaaacatacgagacaacgctggagaagtgctgtgctgccgctgaccctcatgagtgctatgcaaaggtttttgatgaattcaaaccattggttgaagagcctcaaaacttgataaagcagaactgtgagctgtttgagcaattgggtgagtataagttccaaaatgccctgttggtgagatatacaaaaaaggtaccccaagtttcaacgcccactttagttgaagtgtccagaaatcttggtaaagtgggtagcaaatgttgcaagcatccagaagccaagcgaatgccctgtgctgaggattatctgtccgtcgtgttgaaccaattgtgcgtattacacgaaaaaaccccagtctctgatagagtcaccaaatgttgcactgagtcactagttaatagaaggccttgtttttccgctttggaagttgatgaaacctacgtgcctaaggaatttaacgctgagacctttacctttcacgctgacatttgtactttgagtgaaaaagagcgtcaaatcaaaaagcaaaccgctcttgttgaattggtgaaacacaagcctaaggctacgaaggagcagcttaaagccgtcatggacgatttcgccgcatttgttgaaaaatgctgtaaagctgatgacaaggaaacatgtttcgctgaagagggaaagaaattggttgcggccagtcaggcagcgcttggtttgggcggctccggcggaagcgatatcgtgctgacccagagcccggcgaccctgagcctgtctccgggcgaacgtgcgaccctgagctgcagagcgagccagtttattggttctcgttatctggcttggtaccagcagaaaccaggtcaagcaccgcgtctattaatttatggtgcttctaatcgtgcaactggggtcccggcgcgttttagcggctctggatccggcacggattttaccctgaccattagcagcctggaacctgaagactttgcgacttattattgccagcagtattatgattatcctcagacctttggccagggtacgaaagttgaaattaaacgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacgcaccagggcctgtccagccccgtgaccaagagcttcaacaggggcgagtgcggaggtgggggatcgggaggaggtgggtcaggtggaggagggtcagggggagggggctcgggaggcggtggctccggagggggtgggagccaagtgcaattgaaagaaagcggcccggccctggtgaaaccgacccaaaccctgaccctgacctgtaccttttccggatttagcctgtctaatcgtggtggtggtgtgggttggattcgccagccgcctgggaaagccctcgagtggctggcttggatcgattgggatgatgataagtcttatagcaccagcctgaaaacgcgtctgaccattagcaaagatacttcgaaaaatcaggtggtgctgactatgaccaacatggacccggtggatacggccacctattattgcgcgcgtatgcatcttcctcttgtttttgattcttggggccaaggcaccctggtgacggttagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgc

SEQ ID NO: 253 - protein, 211 aa, Homo sapiens; identical to SEQ ID NO: 17

SEQ ID NO: 254 - DNA, 633 bp, Homo sapiens; identical to SEQ ID NO: 169

SEQ ID NO: 255 - protein, 707 aa, Homo sapiens [sequence omitted]

SEQ ID NO: 256 - DNA, 2121 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacaccggcccccccggcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcaccctggacagcaagctgaccgtggacaagtccaggtggcagcagggcaacgtgttcagctgcagcgtgatgcacgaagcgctgcacaaccactacacccagaagagcctgagcctgtcccccggcaagggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagc

SEQ ID NO: 257 - protein, 211 aa, Homo sapiens; identical to SEQ ID NO: 17

SEQ ID NO: 258 - DNA, 633 bp, Homo sapiens; identical to SEQ ID NO: 169

SEQ ID NO: 259 - protein, 929 aa, Homo sapiens [sequence omitted]

SEQ ID NO: 260 - DNA, 2787 bp, Homo sapiens
caggtgcaattggtcgagtctggcggaggactggtgcagcctggtggcagcctgagactgagctgcgccgccagcggcttcaccttcagcgactacgtgatcaactgggtgcgacaggcccctggaaagggcctggaatgggtgtccggcatctcttggtctggcgtgaacacccactacgccgacagcgtgaagggccggttcaccatcagccgggacaacagcaagaacaccctgtacctgcagatgaacagcctgagagccgaggacaccgccgtgtactactgtgccagactgggcgccaccgccaacaacatccggtacaagttcatggacgtgtggggccagggcacactggtgaccgtcagctcagctagcaccaagggccccagcgtgttccccctggcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgtccagcgtggtgacagtgcccagcagcagcctgggcacccagacctacatctgcaacgtgaaccacaagcccagcaacaccaaggtggacaagagagtggagcccaagagctgcgacaagacccacaccggcccccccggcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcaccctggacagcaagctgaccgtggacaagtccaggtggcagcagggcaacgtgttcagctgcagcgtgatgcacgaagcgctgcacaaccactacacccagaagagcctgagcctgtcccccggcaagtcccccccctccccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcaccctggacagcaagctgaccgtggacaagtccaggtggcagcagggcaacgtgttcagctgcagcgtgatgcacgaagccctgcacaaccactacacccagaagagcctgagcctgtcccccggcaagggcggctccggcggaagcgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagc

SEQ ID NO: 261 - protein, 213 aa, Homo sapiens
DIELTQPPSVSVAPGQTARISCSGDNIGSKYVHWYQQKPGQAPVLVIYGDSNRPSGIPERFSGSNSGNTATLTISGTQAEDEADYYCTRTSTPISGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEAC

SEQ ID NO: 262 - DNA, 639 bp, Homo sapiens
gatatcgaactgacccagccgccttcagtgagcgttgcaccaggtcagaccgcgcgtatctcgtgtagcggcgataatattggttctaagtatgttcattggtaccagcagaaacccgggcaggcgccagttcttgtgatttatggtgattctaatcgtccctcaggcatcccggaacgctttagcggatccaacagcggcaacaccgcgaccctgaccattagcggcactcaggcggaagacgaagcggattattattgcactcgtacttctactcctatttctggtgtgtttggcggcggcacgaagttaaccgttcttggccagccgaaagccgcaccgagtgtgacgctgtttccgccgagcagcgaagaattgcaggcgaacaaagcgaccctggtgtgcctgattagcgacttttatccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaggggagcaccgtggaaaaaaccgttgcgccgactgaggcctgc

SEQ ID NO: 263 - protein, 222 aa, Homo sapiens
QVQLVESGGGLVQPGGSLRLSCAASGFTFSVNGMHWVRQAPGKGLEWVSVIDGMGHTYYADSVKGRFTISRDNSKNTLYLQMNSLRAEDTAVYYCARYDYIKYGAFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 264 - DNA, 666 bp, Homo sapiens
caggtgcaattggtggaaagcggcggcggcctggtgcaaccgggcggcagcctgcgtctgagctgcgcggcctccggatttaccttttctgttaatggtatgcattgggtgcgccaagcccctgggaagggtctcgagtgggtgagcgttattgatggtatgggtcatacttattatgctgattctgttaagggtcgttttaccatttcacgtgataattcgaaaaacaccctgtatctgcaaatgaacagcctgcgtgcggaagatacggccgtgtattattgcgcgcgttatgattatattaagtatggtgcttttgatccttggggccaaggcaccctggtgacggttagctcagcgtcgaccaaaggtccaagcgtgtttccgctggctccgagcagcaaaagcaccagcggcggcacggctgccctgggctgcctggttaaagattatttcccggaaccagtcaccgtgagctggaacagcggggcgctgaccagcggcgtgcatacctttccggcggtgctgcaaagcagcggcctgtatagcctgagcagcgttgtgaccgtgccgagcagcagcttaggcactcagacctatatttgcaacgtgaaccataaaccgagcaacaccaaagtggataaaaaagtggaaccgaaaagctgc

SEQ ID NO: 265 - protein, 1105 aa, Homo sapiens
QVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSAAAENLYFQGSHHHHHH

SEQ ID NO: 266 - DNA, 3315 bp, Homo sapiens
caggttcaattggttgaaagcggtggtggtctggttcagcctggtggtagcctgcgtctgagctgtgcagcaagcggttttacctttagcgattatgtgattaattgggttcgtcaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggcggcgctggatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagcgcggccgcagagaacctgtattttcagggtagccaccatcatcaccatcac

SEQ ID NO: 267 - protein, 1105 aa, Homo sapiens
QVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSAAAENLYFQGSHHHHHH

SEQ ID NO: 268 - DNA, 3315 bp, Homo sapiens
caggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggcggcgctggatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgcggccgcagagaacctgtattttcagggtagccaccatcatcaccatcac

SEQ ID NO: 269 - protein, 1105 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARMHLPLVFDSWGQGTLVTVSSAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQVQLVESGGGLVQPGGSLRLSCAASGFTFSDYVINWVRQAPGKGLEWVSGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAAENLYFQGSHHHHHH

SEQ ID NO: 270 - DNA, 3315 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggatgcatctgcccctggtgttcgatagctggggccagggaaccctggtgacagtgtccagcgcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggcggcgctgcaggttcaattggttgaaagcggtggtggtctggttcagcctggtggtagcctgcgtctgagctgtgcagcaagcggttttacctttagcgattatgtgattaattgggttcgtcaggcaccgggtaaaggtctggaatgggttagcggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgcagagaacctgtattttcagggtagccaccatcatcaccatcac

SEQ ID NO: 271 - protein, 1105 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAAENLYFQGSHHHHHH

SEQ ID NO: 272 - DNA, 3315 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggcggcgctgcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgcagagaacctgtattttcagggtagccaccatcatcaccatcac

SEQ ID NO: 273 - protein, 1120 aa, Homo sapiens [sequence omitted]

SEQ ID NO: 274 - DNA, 3360 bp, Homo sapiens
caggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggggggtggcggaagtgggggtgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggggggtggcggaagtgggggtggcggaagtgggggtggcggaagtgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgcggccgcagagaacctgtattttcagggtagccaccatcatcaccatcac

SEQ ID NO: 275 - protein, 1120 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSGGGGSGGDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLGGGGSGGGGSGGGGSQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAAENLYFQGSHHHHHH

SEQ ID NO: 276 - DNA, 3360 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgggggtggcggaagtgggggtgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggggggtggcggaagtgggggtggcggaagtgggggtggcggaagtcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgcagagaacctgtattttcagggtagccaccatcatcaccatcac

SEQ ID NO: 277 - protein, 1091 aa, Homo sapiens
QVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSAAA

SEQ ID NO: 278 - DNA, 3273 bp, Homo sapiens
caggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggcggcgctggatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgcggccgca

SEQ ID NO: 279 - protein, 1091 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAA

SEQ ID NO: 280 - DNA, 3273 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggcggcgctgcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgca

SEQ ID NO: 281 - protein, 1098 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAAENLYFQGSHHHHHH

SEQ ID NO: 282 - DNA, 3294 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctgcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgcagagaacctgtattttcagggtagccaccatcatcaccatcac

SEQ ID NO: 283 - protein, 1106 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSKTHTDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLKTHTQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAAENLYFQGSHHHHHH

SEQ ID NO: 284 - DNA, 3318 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcaagacccacaccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctgaagacccacacccaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgcagagaacctgtattttcagggtagccaccatcatcaccatcac

SEQ ID NO: 285 - protein, 528 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSGGGGSGGGGSGGGGSQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAAENLYFQGSHHHHHH

SEQ ID NO: 286 - DNA, 1584 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcggaggtggcgggagtggtggagggggctcaggcgggggtggatctcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgcagagaacctgtattttcagggtagccaccatcatcaccatcac

SEQ ID NO: 287 - protein, 1110 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSGGGGSGGGGSGGGGSQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLDKTHTDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAAHHHHHH

SEQ ID NO: 288 - DNA, 3330 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcggaggtggcgggagtggtggagggggctcaggcgggggtggatctcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggacaagacccacaccgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcagctgcccatcaccaccatcatcat

SEQ ID NO: 289 - protein, 854 aa, Homo sapiens
QVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAAENLYFQGSHHHHHH

SEQ ID NO: 290 - DNA, 2562 bp, Homo sapiens
caggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggccgcagagaacctgtattttcagggtagccaccatcatcaccatcac

SEQ ID NO: 291 - protein, 852 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAAENLYFQGSHHHHHH

SEQ ID NO: 292 - DNA, 2556 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgcggcgagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggcggccgcagagaacctgtattttcagggtagccaccatcatcaccatcac

SEQ ID NO: 293 - protein, 1084 aa, Homo sapiens
QVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSSYELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSAAA

SEQ ID NO: 294 - DNA, 3252 bp, Homo sapiens
caggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagctcttacgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctggatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgcggccgca

SEQ ID NO: 295 - protein, 1084 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSSYELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLAAA

SEQ ID NO: 296 - DNA, 3252 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgacgctcacaagagcgaagtggcacataggttcaaagatctgggcgaagagaactttaaggccctcgtcctgatcgctttcgcacagtacctccagcagtctccctttgaagatcacgtgaaactggtcaatgaggtgaccgaatttgccaagacatgcgtggctgatgagagtgcagaaaactgtgacaaatcactgcatactctctttggagataagctgtgcaccgtcgccacactcagagagacttatggggaaatggctgactgttgcgcaaaacaggagcctgaacggaatgagtgtttcctccagcacaaggatgacaacccaaatctgccccgcctcgtgcgacctgaggtcgatgtgatgtgcaccgcctttcatgacaacgaagagacattcctgaagaaatacctgtatgaaattgctcgtaggcacccatacttttatgcccccgagctcctgttctttgcaaagagatacaaagctgccttcactgaatgttgccaggcagctgataaggccgcatgtctcctgcctaaactggacgagctccgggatgaaggtaaggcttccagcgccaaacagcgcctgaagtgcgcttctctccagaagtttggcgagcgagcattcaaagcctgggctgtggcccgtctcagtcagaggtttccaaaggcagaatttgctgaggtctcaaaactggtgaccgacctcacaaaggtccatactgagtgttgccacggagatctgctggaatgtgccgacgatagagcagacctcgctaaatatatctgcgagaatcaggattccattagctctaagctgaaagaatgttgcgagaagcccctcctggaaaagagtcattgtatcgccgaggtggaaaacgacgagatgccagcagatctgccatcactcgctgccgactttgtggaatccaaagatgtctgcaagaattacgcagaggctaaagacgtgttcctggggatgtttctgtatgagtacgcccggcgtcaccccgattatagcgtcgtgctcctgctccgactggcaaagacctacgaaacaactctggagaaatgttgcgctgccgcagaccctcatgaatgttatgctaaggtgttcgatgagtttaagccactcgtcgaagagccccagaacctgattaaacagaattgcgaactgttcgagcagctcggtgaatacaagtttcagaacgccctgctcgtgcgttataccaaaaaggtccctcaggtgtctacaccaactctggtggaggtcagtaggaatctgggcaaagtgggatcaaagtgttgcaaacaccccgaggcaaagagaatgccttgtgctgaagattacctctccgtcgtgctgaaccagctctgcgtgctgcatgaaaagaccccagtcagcgatcgggtgacaaaatgttgcaccgaatctctggtcaatcgccgaccctgtttcagtgccctcgaagtggacgaaacttatgtgcctaaggagtttcaggctgaaacattcacctttcacgccgatatctgcactctgtccgagaaagaaaggcagattaagaaacagacagcactggtcgagctcgtgaagcataaaccaaaggctaccaaggagcagctgaaagccgtcatggacgatttcgcagcttttgtggaaaagtgttgcaaagccgacgataaggagacttgtttcgcagaagaggggaaaaagctcgtggctgccagccaggcagctctgggtctgcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagctcttacgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggcggccgca

SEQ ID NO: 297 - protein, 738 aa, Homo sapiens
QVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVLDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSDIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSS

SEQ ID NO: 298 - DNA, 2214 bp, Homo sapiens
caggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggcggcagcggcggtggcggttccggcggtggtggcagcggtggtggtggtagcgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctggacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcaagggaggtggcgggagtggtggagggggctcaggcgggggtggatctgatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggatccgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagc

SEQ ID NO: 299 - protein, 738 aa, Homo sapiens
DIVLTQSPATLSLSPGERATLSCRASQFIGSRYLAWYQQKPGQAPRLLIYGASNRATGVPARFSGSGSGTDFTLTISSLEPEDFATYYCQQYYDYPQTFGQGTKVEIKGGGGSGGGGSGGGGSGGGGSQVQLKESGPALVKPTQTLTLTCTFSGFSLSNRGGGVGWIRQPPGKALEWLAWIDWDDDKSYSTSLKTRLTISKDTSKNQVVLTMTNMDPVDTATYYCARFHLPLVFDSWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQVQLVESGGGLVQPGGSLRLSCAASGFTFSDYVMNWVRQAPGKGLEWVAGISWSGVNTHYADSVKGRFTISRDNSKNTLYLQMNSLRAEDTAVYYCARLGATANNIRYKFMDVWGQGTLVTVSSGGGGSGGGGSGGGGSGGGGSDIELTQPPSVSVAPGQTARISCSGDSLRNKVYWYQQKPGQAPVLVIYKNNRPSGIPERFSGSNSGNTATLTISGTQAEDEADYYCQSYDGQKSLVFGGGTKLTVL

SEQ ID NO: 300 - DNA, 2214 bp, Homo sapiens
gatatcgtgctgacacagagccctgccaccctgtctctgagccctggcgagagagccaccctgagctgccgggccagccagttcatcggctcccgctacctggcctggtatcagcagaagcccggacaggctcccagactgctgatctacggcgccagcaacagagctaccggcgtgcccgccagattttctggcagcggcagcggcaccgacttcaccctgaccatcagcagcctggaacccgaggacttcgccacctactactgccagcagtactacgactacccccagaccttcggccagggcaccaaggtggagatcaagggcggaggcggaagcgggggtggcggaagtggaggcggaggaagcggagggggcggaagccaggtgcaattgaaagagtccggccctgccctggtgaagcctacccagaccctgaccctgacatgcaccttcagcggcttcagcctgagcaacagaggcggcggagtgggctggatcagacagcctcccggcaaggccctggaatggctggcctggatcgactgggacgacgacaagagctacagcaccagcctgaaaacccggctgaccatctccaaggacaccagcaagaaccaggtggtgctcaccatgaccaacatggaccccgtggacaccgccacctattattgcgcccggtttcatctgcccctggtgttcgatagctggggccagggaaccctggtgacagtgtccagcgacaagacccacacctgccccccctgcccagccccagaggcagcgggcggaccctccgtgttcctgttcccccccaagcccaaggacaccctgatgatcagcaggacccccgaggtgacctgcgtggtggtggacgtgagccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggaatacaagtgcaaggtctccaacaaggccctgccagcccccatcgaaaagaccatcagcaaggccaagggccagccacgggagccccaggtgtacaccctgcccccctcccgggaggagatgaccaagaaccaggtgtccctgacctgtctggtgaagggcttctaccccagcgacatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaagcgctgcacaaccactacacccagaagagcctgagcctgtcccccggcaagggaggtggcgggagtggtggagggggctcaggcgggggtggatctcaggttcaattggttgaaagcggtggtggtctggttcagcctggtggtagcctgcgtctgagctgtgcagcaagcggttttacctttagcgattatgtgatgaattgggttcgtcaggcaccgggtaaaggtctggaatgggttgccggtattagctggtcaggtgttaatacccattatgcagatagcgtgaaaggtcgttttaccattagccgtgataatagcaaaaataccctgtatctgcagatgaatagcctgcgtgcagaagataccgcagtttattattgtgcacgtctgggtgcaaccgcaaataatattcgctataaatttatggatgtgtggggtcagggtacactagttaccgttagcagtggtggtggtggtagcggtggtggcggatctggtggcggtggttcaggtggtggtggcagtgatatcgaactgacccagcctccgagcgttagcgttgcaccgggtcagaccgcacgtattagctgtagcggtgatagtctgcgtaataaagtttattggtatcagcagaaaccgggtcaggctccggttctggttatttataaaaataatcgtccgagcggtattccggaacgttttagcggtagcaatagcggtaataccgcaaccctgaccattagcggcacccaggcagaagatgaagccgattattattgtcagagctatgatggtcagaaaagcctggtttttggtggtggcaccaagcttaccgttctg

SEQ ID NO: 301 - DNA, 53 bp, Homo sapiens
gctacgtcgcgattctggaaggcgtgcactgtcaggtgcaattggtggaaagc

SEQ ID NO: 302 - DNA, 30 bp, Homo sapiens
gctacggctagctgagctaaccgtcaccag

SEQ ID NO: 303 - DNA, 33 bp, Homo sapiens
gctacgaccggtgatatcgaactgacccagccg

SEQ ID NO: 304 - DNA, 28 bp, Homo sapiens
gctacgaagcttcgtgccgccgccaaac

SEQ ID NO: 305 - DNA, 33 bp, Homo sapiens
cagtacctgcagaagtccagctacgacgagcac

SEQ ID NO: 306 - DNA, 33 bp, Homo sapiens
gtgctcgtcgtagctggacttctgcaggtactg

SEQ ID NO: 307 - DNA, 23 bp, Homo sapiens
ggcccacaagagcgagatcgccc

SEQ ID NO: 308 - DNA, 78 bp, Homo sapiens
gcggccgcccggcgcgcctcatcagtgatggtgatgatggtgggccagggcgtccttggaccgggtcaccaggttggg

SEQ ID NO: 309 - DNA, 36 bp, Homo sapiens
tgtcaggtgcaattggtcgagtctggcggaggactg

SEQ ID NO: 310 - DNA, 20 bp, Homo sapiens
ccttggtgctggctgagctg

SEQ ID NO: 311 - DNA, 39 bp, Homo sapiens
gcttccggacaccaccggtgacatcgagctgacccagcc

SEQ ID NO: 312 - DNA, 36 bp, Homo sapiens
cagcacggtaagcttggtgcctccgccgaacaccag

SEQ ID NO: 313 - DNA, 53 bp, Homo sapiens; identical to SEQ ID NO: 301

SEQ ID NO: 314 - DNA, 30 bp, Homo sapiens; identical to SEQ ID NO: 302

SEQ ID NO: 315 - DNA, 31 bp, Homo sapiens
ggtccaactgcacggtagctttctagagccg

SEQ ID NO: 316 - DNA, 31 bp, Homo sapiens
cggctctagaaagctaccgtgcagttggacc

SEQ ID NO: 317 - DNA, 27 bp, Homo sapiens
gcggaacaaagcttaccgtgctgggcc

SEQ ID NO: 318 - DNA, 27 bp, Homo sapiens
ggcccagcacggtaagctttgttccgc

SEQ ID NO: 319 - DNA, 33 bp, Homo sapiens; identical to SEQ ID NO: 303

SEQ ID NO: 320 - DNA, 28 bp, Homo sapiens
gctacgaagcttcgtgccgccgccaaac

SEQ ID NO: 321 - DNA, 29 bp, Homo sapiens
ggccagggcacacttgtgaccgtcagctc

SEQ ID NO: 322 - DNA, 29 bp, Homo sapiens
gagctgacggtcacaagtgtgccctggcc

SEQ ID NO: 323 - DNA, 80 bp, Homo sapiens
ggccccaacctggtgacccggtccaaggacgccctggccggcggctccggcggaagcgatatcgtgctgacacagagccc

SEQ ID NO: 324 - DNA, 64 bp, Homo sapiens
gtttaaacgggccctctagagcggccgcccggcgcgcctcagctggacactgtcaccagggttc

SEQ ID NO: 325 - DNA, 32 bp, Homo sapiens
gcggccagtcaggcagcgcttggtttgtgatg

SEQ ID NO: 326 - DNA, 32 bp, Homo sapiens
catcacaaaccaagcgctgcctgactggccgc

SEQ ID NO: 327 - DNA, 43 bp, Homo sapiens
caggcagcgcttggtttgggcggctccggcggaagcgatatcg

SEQ ID NO: 328 - DNA, 24 bp, Homo sapiens
gggtttaaacgggccctctagagc

SEQ ID NO: 329 - DNA, 58 bp, Homo sapiens
caggcagcgcttggtttgggcggctccggcggaagcgatatcgtgctgacccagagcc

SEQ ID NO: 330 - DNA, 59 bp, Homo sapiens
gccctctagagcggccgcccggcgcgcctcatcagcagctcttgggctccactctcttg

SEQ ID NO: 331 - DNA, 39 bp, Homo sapiens
caagacccacaccggcccccccggcccagccccagaggc

SEQ ID NO: 332 - DNA, 39 bp, Homo sapiens
gcctctggggctgggccgggggggccggtgtgggtcttg

SEQ ID NO: 333 - DNA, 35 bp, Homo sapiens
gcgacggcagcttcaccctggacagcaagctgacc

SEQ ID NO: 334 - DNA, 35 bp, Homo sapiens
ggtcagcttgctgtccagggtgaagctgccgtcgc

SEQ ID NO: 335 - DNA, 40 bp, Homo sapiens
ccgttgcgccgactgaggcctgctgataagcatgcgtagg

SEQ ID NO: 336 - DNA, 40 bp, Homo sapiens
cctacgcatgcttatcagcaggcctcagtcggcgcaacgg

---

We claim:

1. An isolated low density lipoprotein-related protein 6 (LRP6) construct comprising first and second LRP6 single chain Fv molecules (scFvs) that bind to LRP6, and a human serum albumin, wherein the first and second scFv molecules are linked to the N- and C-termini of the human serum albumin, wherein the LRP6 construct inhibits a canonical Wnt signal transduction pathway, and wherein the the LRP6 construct displays no significant potentiation of a Wnt signal in the presence of an LRP6 binding protein.

2. The isolated construct of claim 1, wherein the first LRP6 scFv is linked to the N-terminal of the human serum albumin and binds to the Propeller 1 region of LRP6, and the second LRP6 scFv is linked to the C-terminal of the human serum albumin and binds to the Propeller 3 region of LRP6.

3. The isolated construct of claim 1, wherein the first LRP6 scFv is linked to the C-terminal of the human serum albumin and binds to the Propeller 1 region of LRP6, and the second LRP6 scFv is linked to the N-terminal of the human serum albumin and binds to the Propeller 3 region of LRP6.

4. The isolated construct of claim 1, wherein the LRP6 binding protein is a Wnt binding protein selected from the group consisting of Wnt 1, Wnt 3, and Wnt 3a.

5. The isolated construct of claim 1, wherein the first and second LRP6 scFvs are indirectly linked to the N- and C-termini of the human serum albumin via an attachment linker selected from the group consisting of an Fc linker, a hinge linker, a Gly-Ser linker, an Ala linker, and a KTHT linker.

6. The isolated construct of claim 1, wherein the first and second LRP6 scFvs are directly linked to the N- and C-termini of the human serum albumin by direct fusion to the human serum albumin.

7. The isolated construct of claim 1, wherein the human serum albumin is selected from the group consisting of a mutant human serum albumin, or a fragment of a human serum albumin.

8. The isolated construct of claim 7, wherein the mutant human serum albumin comprises mutations C34S and N503Q.

9. The isolated construct of claim 7, wherein the fragment of human serum albumin comprises at least one domain of human serum albumin selected from the group consisting of DI, DII, DIII, and DIV.

10. The isolated construct of claim 1, wherein the first or second scFv fragment comprises at least one amino acid mutation that improves stability of the scFv compared with the unmutated scFv fragment, wherein the amino acid mutation is selected from:

VH:G34V, VH:I37F, VH:V85E, and VH:M95F of scFv06475 VH (SEQ ID NO: 82) using the Kabat numbering system;

VL:D93N of scFv06475 VL (SEQ ID NO: 81) using the Kabat numbering system;

VH:V33N, VH:I34M, VH:I34F, VH:V48I, VH:S49A, VH:G50S, VH:W52aG, and VH:H58Y of scFv08168 VH (SEQ ID NO: 14) using the Kabat numbering system; and VL:S22T, VL:V47L, VL:G64V, and VL:T78V of scFv08168 VL (SEQ ID NO: 13) using the Kabat numbering system.

11. The isolated construct of claim 10, wherein the scFv fragment binds to the Propeller 1 region of LRP6 and comprises at least one amino acid mutation that improves stability of the scFv compared with the unmutated scFv fragment, wherein the amino acid mutation is in a selected from the group consisting of I34M and S49A.

12. The isolated construct of claim 10, wherein the scFv fragment binds to the Propeller 3 region of LRP6 and comprises at least one amino acid mutation that improves stability of the scFv compared with the unmutated scFv fragment, wherein the amino acid mutation is M95F.

13. The isolated construct of claim 10, wherein the scFv fragment binds to the Propeller 1 region of LRP6 and comprises at least one amino acid mutation that improves stability of the scFv compared with the unmutated scFv fragment, wherein the amino acid mutation is in a selected from the group consisting of I34M and S49A; and an scFv fragment that binds to the Propeller 3 region of LRP6 and comprises at least one amino acid mutation that improves stability of the scFv compared with the unmutated scFv fragment, wherein the amino acid mutation is M95F.

14. The isolated construct of claim 1, wherein the construct inhibits phosphorylation of LRP6 as assessed by a Wnt ligand induced phosphorylation assay.

15. The isolated construct of claim 1, wherein the construct has the functional activity of depleting a cell population, inhibiting or reducing proliferation of a cell population, inhibiting or reducing secretion of inflammatory mediators from a cell population, or inhibiting or reducing secretion of cytoplasmic granules from a cell population, wherein the cell population is selected from the group consisting of tumor cells and Wnt dependent cells.

16. The isolated construct of claim 1, wherein the construct shows increased half-life of about 5 hours compared with the first or second LRP6 single chain Fv molecule without a half-life extender.

17. The isolated low density lipoprotein-related protein 6 (LRP6) construct of claim 1 comprising SEQ ID NO: 293 or an amino acid sequence comprising at least 95% sequence identity with SEQ ID NO: 293.

18. The isolated low density lipoprotein-related protein 6 (LRP6) construct of claim 1 comprising SEQ ID NO: 295 or an amino acid sequence comprising at least 95% sequence identity with SEQ ID NO: 295.

19. A nucleic acid comprising a nucleotide sequence encoding a low density lipoprotein-related protein 6 (LRP6) construct of claim 1.

20. The nucleic acid of claim 19 comprising a nucleotide sequence encoding a low density lipoprotein-related protein 6 (LRP6) construct comprising a SEQ ID NO: 293 or a nucleotide sequence comprising at least 98% sequence identity with SEQ ID NO: 293.

21. The nucleic acid of claim 19 comprising a nucleotide sequence encoding a low density lipoprotein-related protein 6 (LRP6) construct comprising a SEQ ID NO: 295 or a nucleotide sequence comprising at least 98% sequence identity with SEQ ID NO: 295.

22. A vector comprising the nucleic acid of claim 19.

23. A pharmaceutical composition comprising a low density lipoprotein-related protein 6 (LRP6) construct of claim 1 and a pharmaceutically acceptable carrier.

24. The isolated construct of claim 1, wherein the first or the second LRP6 scFv is indirectly linked to the N- and C-termini of the human serum albumin via an attachment linker selected from the group consisting of an Fc linker, a hinge linker, a Gly-Ser linker, an Ala linker, and a KTHT linker.

25. The isolated construct of claim 7, wherein the human serum albumin is a mutant human serum albumin.

26. The isolated construct of claim 1, which comprises six CDRs according to SEQ ID NOS: 1-6.

27. The isolated construct of claim 1, which comprises six CDRs according to SEQ ID NOS: 7-12.

28. The isolated construct of claim 1, which comprises six CDRs according to SEQ ID NOS: 69-74.

29. The isolated construct of claim 1, which comprises six CDRs according to SEQ ID NOS: 75-80.

30. The isolated construct of claim 1, which inhibits Wnt 1 and Wnt 3a signalling.

31. The isolated construct of claim 15, which has the functional activity of inhibiting or reducing proliferation of a cell population.

32. The isolated construct of claim 1, which has a half-life of at least 18 hours in serum.

33. The isolated low density lipoprotein-related protein 6 (LRP6) construct of claim 1 comprising an amino acid sequence that comprises at least 90% sequence identity with SEQ ID NO: 293.

34. The isolated low density lipoprotein-related protein 6 (LRP6) construct of claim 1 comprising an amino acid sequence that comprises at least 90% sequence identity with SEQ ID NO: 295.

* * * * *